US009458245B2

(12) United States Patent
Harms et al.

(10) Patent No.: US 9,458,245 B2
(45) Date of Patent: Oct. 4, 2016

(54) ANTI-C-MET TANDEM FC BISPECIFIC ANTIBODIES

(71) Applicant: Merrimack Pharmaceuticals, Inc., Cambridge, MA (US)

(72) Inventors: Brian Harms, Roslindale, MA (US); Neeraj Kohli, Brighton, MA (US); Alexey Lugovskoy, Woburn, MA (US); Melissa Geddie, Somerville, MA (US); Eric Mark Krauland, Lebanon, NH (US); William George Roach, Lebanon, NH (US); Stephen Su, Boston, MA (US); Adnan Abu-Yousif, Boston, MA (US)

(73) Assignee: Merrimack Pharmaceuticals, Inc., Cambridge, MA (US)

(*) Notice: Subject to any disclaimer, the term of this patent is extended or adjusted under 35 U.S.C. 154(b) by 24 days.

(21) Appl. No.: 14/199,760

(22) Filed: Mar. 6, 2014

(65) Prior Publication Data

US 2014/0302035 A1 Oct. 9, 2014

Related U.S. Application Data

(60) Provisional application No. 61/773,764, filed on Mar. 6, 2013, provisional application No. 61/773,788, filed on Mar. 6, 2013.

(51) Int. Cl.

| | |
|---|---|
| ***C07K 16/30*** | (2006.01) |
| ***C07K 16/46*** | (2006.01) |
| ***C07K 16/28*** | (2006.01) |
| *A61K 39/00* | (2006.01) |

(52) U.S. Cl.

CPC ......... *C07K 16/468* (2013.01); *C07K 16/2863* (2013.01); *C07K 16/30* (2013.01); *A61K 2039/505* (2013.01); *C07K 2317/24* (2013.01); *C07K 2317/31* (2013.01); *C07K 2317/52* (2013.01); *C07K 2317/55* (2013.01); *C07K 2317/622* (2013.01); *C07K 2317/64* (2013.01); *C07K 2317/73* (2013.01); *C07K 2317/76* (2013.01); *C07K 2317/92* (2013.01); *C07K 2317/94* (2013.01); *C07K 2319/00* (2013.01)

(58) Field of Classification Search

None

See application file for complete search history.

(56) References Cited

U.S. PATENT DOCUMENTS

| | | | |
|---|---|---|---|
| 5,624,821 | A | 4/1997 | Winter et al. |
| 5,648,260 | A | 7/1997 | Winter et al. |
| 5,686,292 | A | 11/1997 | Schwall et al. |
| 5,821,337 | A | 10/1998 | Carter et al. |
| 5,892,019 | A | 4/1999 | Schlom et al. |
| 6,344,339 | B1 | 2/2002 | Menrad et al. |
| 6,602,648 | B2 | 8/2003 | Nakamura |
| 6,696,548 | B2 | 2/2004 | Morris et al. |
| 6,972,324 | B2 | 12/2005 | Adolf et al. |
| 7,183,076 | B2 | 2/2007 | Arathoon et al. |
| 7,332,579 | B2 | 2/2008 | Gerritsen et al. |
| 7,402,298 | B1 | 7/2008 | Kinch et al. |
| 7,476,724 | B2 | 1/2009 | Dennis et al. |
| 7,560,111 | B2 | 7/2009 | Kao et al. |
| 7,626,011 | B2 | 12/2009 | Begent et al. |
| 7,642,228 | B2 | 1/2010 | Carter et al. |
| 7,700,742 | B2 | 4/2010 | Cohen et al. |
| 7,705,130 | B2 | 4/2010 | Rothe et al. |
| 7,740,850 | B2 | 6/2010 | Zhu et al. |
| 7,776,328 | B2 | 8/2010 | Mather et al. |
| 7,846,440 | B2 | 12/2010 | Schoeberl et al. |
| 7,871,611 | B2 | 1/2011 | Calzone et al. |
| 7,902,340 | B2 | 3/2011 | Auf Der Maur et al. |
| 7,915,391 | B2 | 3/2011 | Ng et al. |
| 7,947,811 | B2 | 5/2011 | Pereira et al. |
| 7,976,842 | B2 | 7/2011 | Reinhardt et al. |
| 8,057,791 | B2 | 11/2011 | Zhu |
| 8,071,072 | B2 | 12/2011 | Young et al. |
| 8,128,929 | B2 | 3/2012 | Loizos et al. |
| 2003/0003097 | A1 | 1/2003 | Reff et al. |
| 2003/0157054 | A1 | 8/2003 | Gillies et al. |
| 2006/0127893 | A1 | 6/2006 | Ewert et al. |
| 2006/0134104 | A1 | 6/2006 | Dennis et al. |

(Continued)

FOREIGN PATENT DOCUMENTS

| | | | |
|---|---|---|---|
| EP | 0586445 | B1 | 3/1999 |
| EP | 1423428 | B1 | 8/2009 |

(Continued)

OTHER PUBLICATIONS

Paul, Fundamental Immunology, 3rd Edition, 1993, pp. 292-295.*

(Continued)

*Primary Examiner* — Sheela J Huff

*Assistant Examiner* — Michael D Allen

(74) *Attorney, Agent, or Firm* — Nelson Mullins Riley & Scarborough LLP; Jane E. Remillard, Esq.; Christopher L. Frank

(57) ABSTRACT

Provided herein are tandem Fcs and tandem Fc antibodies ("TFcAs"), e.g., tandem Fc bispecific antibodies ("TFcBAs"), which comprise one or at least two binding sites that specifically bind to one or more cell surface receptors. The binding sites are connected through a TFc, which TFc comprises a first Fc region and a second Fc region, wherein the first and the second Fc regions are linked through a TFc linker to form a contiguous polypeptide and dimerize to form an Fc dimer. Exemplary TFcBAs bind to the cell surface receptors c-Met and EpCam and inhibit signal transduction through the cell surface receptor(s) for which the binding sites of the TFcBA are specific.

3 Claims, 147 Drawing Sheets

(56) References Cited

U.S. PATENT DOCUMENTS

| | | | |
|---|---|---|---|
| 2007/0111281 | A1 | 5/2007 | Sondermann et al. |
| 2008/0008713 | A1 | 1/2008 | Brewis |
| 2009/0048122 | A1 | 2/2009 | Glaser et al. |
| 2009/0226442 | A1 | 9/2009 | Huet et al. |
| 2010/0009390 | A1 | 1/2010 | Marks et al. |
| 2010/0169992 | A1 | 7/2010 | Bange |
| 2010/0190964 | A1 | 7/2010 | Gerritsen et al. |
| 2010/0255013 | A1 | 10/2010 | Presta |
| 2010/0330095 | A1 | 12/2010 | Hettmann et al. |
| 2012/0121587 | A1 | 5/2012 | Maeda et al. |
| 2014/0294834 | A1 | 10/2014 | Harms et al. |

FOREIGN PATENT DOCUMENTS

| | | | |
|---|---|---|---|
| EP | 1972637 | B1 | 6/2011 |
| EP | 1575509 | B1 | 10/2011 |
| WO | 9500659 | A1 | 1/1995 |
| WO | 0061739 | A1 | 10/2000 |
| WO | 0107082 | A1 | 2/2001 |
| WO | 0129246 | A1 | 4/2001 |
| WO | 0230954 | A1 | 4/2002 |
| WO | 0231140 | A1 | 4/2002 |
| WO | 03063893 | A2 | 8/2003 |
| WO | 2004072117 | A2 | 8/2004 |
| WO | 2004108766 | A2 | 12/2004 |
| WO | 2005016382 | A1 | 2/2005 |
| WO | 2005018572 | A2 | 3/2005 |
| WO | 2005037235 | A2 | 4/2005 |
| WO | 2005047327 | A2 | 5/2005 |
| WO | 2005063815 | A2 | 7/2005 |
| WO | 2005063816 | A2 | 7/2005 |
| WO | 2006015371 | A2 | 2/2006 |
| WO | 2006082515 | A2 | 8/2006 |
| WO | 2006104911 | A2 | 10/2006 |
| WO | 2007126799 | A2 | 11/2007 |
| WO | 2008052796 | A1 | 5/2008 |
| WO | 2008079246 | A2 | 7/2008 |
| WO | 2008131242 | A1 | 10/2008 |
| WO | 2008131575 | A2 | 11/2008 |
| WO | 2008143954 | A2 | 11/2008 |
| WO | 2009007427 | A2 | 1/2009 |
| WO | 2009039630 | A1 | 4/2009 |
| WO | 2009089004 | A1 | 7/2009 |
| WO | 2010002862 | A2 | 1/2010 |
| WO | 2010064090 | A1 | 6/2010 |
| WO | 2010115553 | A1 | 10/2010 |
| WO | 2011028952 | A1 | 3/2011 |
| WO | 2011110642 | A2 | 9/2011 |
| WO | 2011136911 | A2 | 11/2011 |
| WO | 2011143318 | A2 | 11/2011 |
| WO | 2011159980 | A1 | 12/2011 |
| WO | 2012006341 | A2 | 1/2012 |
| WO | 2012006633 | A1 | 1/2013 |
| WO | 2013033008 | A2 | 3/2013 |

OTHER PUBLICATIONS

Bendig M. M. (Methods: A Companion to Methods in Enzymology, 1995; 8:83-93).*

Rudikoff et al. (Proceedings of the National Academy of Sciences USA, vol. 79, p. 1979-1983, 1982).*

MacCallum et al. 'Antibody-antigen Interactions: Contact Analysis and Binding Site Topography'. Journal of Molecular Biology. 1996, vol. 262, pp. 732-745.

Herbst et al. 'Monoclonal Antibodies to Target Epidermal Growth Factor Receptor—Positive Tumors'. Cancer 2002, vol. 94, No. 5, pp. 1593-1611.

Mendelsohn et al. 'The EGF Receptor Family as Targets for Cancer Therapy'. Oncogene, 2000, vol. 19, pp. 6550-6565.

Atalay et al. 'Novel Therapeutic Strategies Targeting the Epidermal Growth Factor Receptor (EGFR) Family and its Downstream Effectors in Breast Cancer'. Annals of Oncology. 2003, vol. 14, No. 9, pp. 1346-1363.

Modjtahedi et al. 'Phase I Trial and Tumor Localizaton of the anti-EGFR Monoclonal anitbody ICR62 in Head and Neck, or Lung Cancer'. British Journal of Cancer. 1996, vol. 73, pp. 228-235.

Hinton et al. 'Engineered Human IgG Antibodies with Longer Serum Half-lives in Primates'. Journal of Biological Chemistry. 2004, vol. 279, No. 8, pp. 6213-6216.

Hinton et al. 'An Engineered Human IgG1 Antibody with Longer Serum Half-Life'. Journal of Immunology. 2006, vol. 176, No. 1, pp. 346-356.

Dall'Acqua et al. 'Increasing the Affinity of a Human IgG1 for the Neonatal Fc Receptor: Biological Consequences'. Journal of Immunology, 2002, vol. 169, pp. 5171-5180.

Dall'Acqua et al. 'Properties of Human IgG1s Engineered for Enhanced Binding to the Neonatal Receptor (FcRn)'. The Journal of Biological Chemistry. 2006, vol. 281, No. 33, pp. 23514-23524.

Yeung et al. 'Engineering Human IgG1 Affinity to Human Neonatal Fc Receptor: Impact of Affinity Improvement on Pharmacokinetics in Primates'. Journal of Immunology. 2009, vol. 182, No. 12, pp. 7663-7671.

Strohl et al. Optimization of Fc-mediated Effector Functions of Monoclonal Antibodies'. Current Opinion in Biotechnology. 2009, vol. 20, No. 6, pp. 685-691.

Crasto et al. 'Linker: A Program to Generate Linker Sequences for Fusion Proteins'. Protein Engineering. 2000, vol. 13, No. 5, pp. 309-312.

George et al. 'An Analysis of Protein Domain Linkers; Their Classification and Role in Protein Folding'. Protein Engineering. 2002, vol. 15, No. 11, pp. 871-879.

Yang et al. 'Development of ABX-EGF, a Fully Human anti-EGF Receptor Monoclonal Antibody, for Cancer Therapy'. Critical Reviews in Oncology/Hematology. 2001, vol. 38, pp. 17-23.

Bhaskar et al. 'A Fully Human, Allosteric Monoclonal Antibody That Activates the Insulin Receptor and Improves Glycemic Control'. Diabetes. 2012, vol. 61, No. 5, pp. 1263-1271.

Ronca et al. 'Antiangiogenic Activity of a Neutralizing Human Single-Chain Antibody Fragment against Fibroblast Growth Receptor 1'. Molecular Cancer Therapeutics. 2010, vol. 9, No. 12, pp. 3244-3253.

Matzke et al. 'A Five-Amino-Acid Peptide Blocks Met- and Ron-Dependent Cell Migration'. Cancer Research. 2005, vol. 65, No. 14, pp. 6105-6110.

Tam et al. 'Noncompetitive Inhibition of Hepatocyte Growth Factor-dependent Met Signaling by a Phage-derived Peptide'. Journal of Molecular Biology. 2009, vol. 385, pp. 79-90.

Makrides et al. 'Components of Vectors for Gene Transfer and Expression in Mammalian Cells'. Protein Expression and Purification. 1999. vol. 17, No. 2, pp. 183-202.

Geisse et al. 'Eukaryotic Expression Systems: A Comparison'. Protein Expression and Purification. 1996, vol. 8, No. 3, pp. 271-282.

Kaufman. 'Overview of Vector Design for Mammalian Gene Expression'. Molecular Biotechnology. 2000, vol. 16, No. 2, pp. 151-161.

Werner et al. 'Appropriate Mammalian Expression Systems for Biopharmaceuticals'. Drug Research. 1998, vol. 48, No. 8, pp. 870-880.

Barnes et al. 'Advances in Animal Cell Recombinant Protein Production: GS-NS0 Expression System'. Cytotechnology. 2000, vol. 32, No. 2, pp. 109-123.

Barnes et al. 'Characterization of the Stability of Recombinant Protein Production in the GS-NS0 Expression System'. Biotechnology and Biotechnology. 2001, vol. 73, No. 4, pp. 261-270.

Durocher et al. 'High-level and High-throughput Recombinant Protein Production by Transient Transfection of Suspension-growing Human 293-EBNA1 Cells'. Nucleic Acids Research. 2002, vol. 30, No. 2, E9.

Orlandi et al. 'Cloning Immunoglobulin Variable Domains for Expression by the Polymerase Chain Reaction;. PNAS. 1989, vol. 86, No. 10, pp. 3833-3837.

Carter et al. 'Humanization of an Anti-p185HER2 Antibody for Human Cancer Therapy'. PNAS. 1992, vol. 89, No. 10, pp. 4285-4289.

(56) References Cited

OTHER PUBLICATIONS

Norderhaug et al. 'Versatile Vectors for Transient and Stable Expression of Recombinant Antibody Molecules in Mammalian Cells'. Journal of Immunological Methods. 1997, vol. 204, No. 1, pp. 77-87.

Schlaeger et al. 'Transient Gene Expression in Mammalian Cells Grown in Serum-free Suspension Culture'. Cytotechnology. 1999, vol. 30, pp. 71-83.

Schlaeger et al. 'The Protein Hydrolysate, Primatone RL, is a Cost-effective Multiple Growth Promoter of Mammalian Cell Culture in Serum-containing and Serum-free Media and Displays Anti-apoptosis Properties'. Journal of Immunological Methods. 1996, vol. 194, No. 2, pp. 191-199.

Vljayalakshmi et al. 'Antibody Purification Methods'. Applied Biochemistry and Biotechnology. 1998, vol. 75, pp. 93-102.

International Search Report for International Application No. PCT/US2012/052490. Dated Dec. 7, 2012. 7 pages.

International Search Report and Written Opinion of the International Searching Authority for International Application No. PCT/US2014/021341 mailed Jul. 8, 2014 (18 pages).

* cited by examiner

Tandem Fc (TFc)

1st Fc region | 2nd Fc region

| 1st Hinge | 1st CH2 | 1st CH3 | (G4S)n | 2nd Hinge | 2nd CH2 | 2nd CH3 |
|---|---|---|---|---|---|---|
| - IgG1 wild type<br>- IgG1 H224C/T225C<br>- IgG1 T223C<br>- IgG4 wild type<br>- IgG1/4 H224C/T225C<br>- IgG1/4 T223C<br>- Other hinges in Fig. 2 | - IgG1<br>- IgG1 N297Q<br>- IgG4<br>- IgG4 T299K | - IgG1 wild type<br>- IgG1 with one or more of the following mutations:<br>- T366S/L368A/Y407V (AEM 1.1)<br>- T366W (AEM 1.2)<br>- Y407T (AEM 2.1)<br>- T366Y (AEM 2.2)<br>- S364H/F405A (AEM 3.1)<br>- Y349T/T394F (AEM 3.2)<br>- K370D/K392D/K409D (AEM 4.1)<br>- E356K/E357K/D399K (AEM 4.2)<br>- Y349C (DiS 1.1)<br>- S354C (DiS 1.2)<br>- C-term. Cys KSCDKT (DiS 2.1) (SEQ ID NO:167)<br>- C-term. Cys GEC (DiS 2.2)<br>- Any combination of one or more AEMs and/or DiSs | n=<br>5x<br>6x<br>7x<br>8x | - IgG1 core/ lower hinge<br>- IgG4 core/ lower hinge<br>- Other hinges in Fig. 2 | - IgG1<br>- IgG1 N297Q<br>- IgG4<br>- IgG4 T299K | - IgG1 wild type<br>- IgG1 with one or more of the following mutations:<br>- T366W (AEM 1.2)<br>- T366S/L368A/Y407V (AEM 1.1)<br>- T366Y (AEM 2.2)<br>-Y407T (AEM 2.1)<br>- Y349T/T394F (AEM 3.2)<br>- S364H/F405A (AEM 3.1)<br>- E356K/E357K/D399K (AEM 4.2)<br>- K370D/K392D/K409D (AEM 4.1)<br>- S354C (DiS 1.2)<br>- Y349C (DiS 1.1)<br>- C-term. Cys GEC (DiS 2.2)<br>- C-term. Cys KSCDKT (DiS 2.1)(SEQ ID NO:167)<br>- Any combination of one or more AEMs and/or DiSs |

```
               hIgG1 hinges:

                   220        230
                    |          |
Wild type      EPKSCDKTHTCPPCPAPELLG        SEQ ID NO:4
               ----------                   SEQ ID NO:1
                         -----              SEQ ID NO:2
                              ------        SEQ ID NO:3
H224C/T225C    --------CC                   SEQ ID NO:16
T223C          -------C--                   SEQ ID NO:17
H224C/T225C    --------CC-----------        SEQ ID NO:18
T223C          -------C-------------        SEQ ID NO:19
                         -----------        SEQ ID NO:23
Extra Ps v1    PPPP----------               SEQ ID NO:263
Extra Ps v2    -----PPP  -----              SEQ ID NO:264
Double core    ----      -----C-PCP         SEQ ID NO:265
```

Fig. 2B

```
               hIgG1/IgG4 hvbrid hinges:

                   220        230
                    |          |
Wild type      EPKSCDKTHTcpscpapeflg        SEQ ID NO:20
               ----------                   SEQ ID NO:1
                         -----              SEQ ID NO:13
                              ------        SEQ ID NO:14
H224C/T225C    --------CC-----------        SEQ ID NO:21
T223C          -------C-------------        SEQ ID NO:22
T223C                    -----------        SEQ ID NO:24
```

Fig. 2C mIgG1 hinges:

```
220
|
Wild type      VPRDCGCKPCICT             SEQ ID NO:266
mIgG1/mIgG2A   ------TI---PPCP           SEQ ID NO:267
```

Fig. 2D hIgG2 hinges:

```
               230        240
                |          |
Wild type      ERKCCVECPPCPAPPVAGP       SEQ ID NO:7
C232P          ---P--------              SEQ ID NO:268
C233P          ----P-------              SEQ ID NO:269
```

Fig. 2E hIgA2 hinges:

```
Wild type      VPPPPP                    SEQ ID NO:270
Modified v1    EPKSCPC-----CCP           SEQ ID NO:271
Modified v2    EPKSCPC----CCP            SEQ ID NO:272
Modified v3    EPKSCP------CCP           SEQ ID NO:273
```

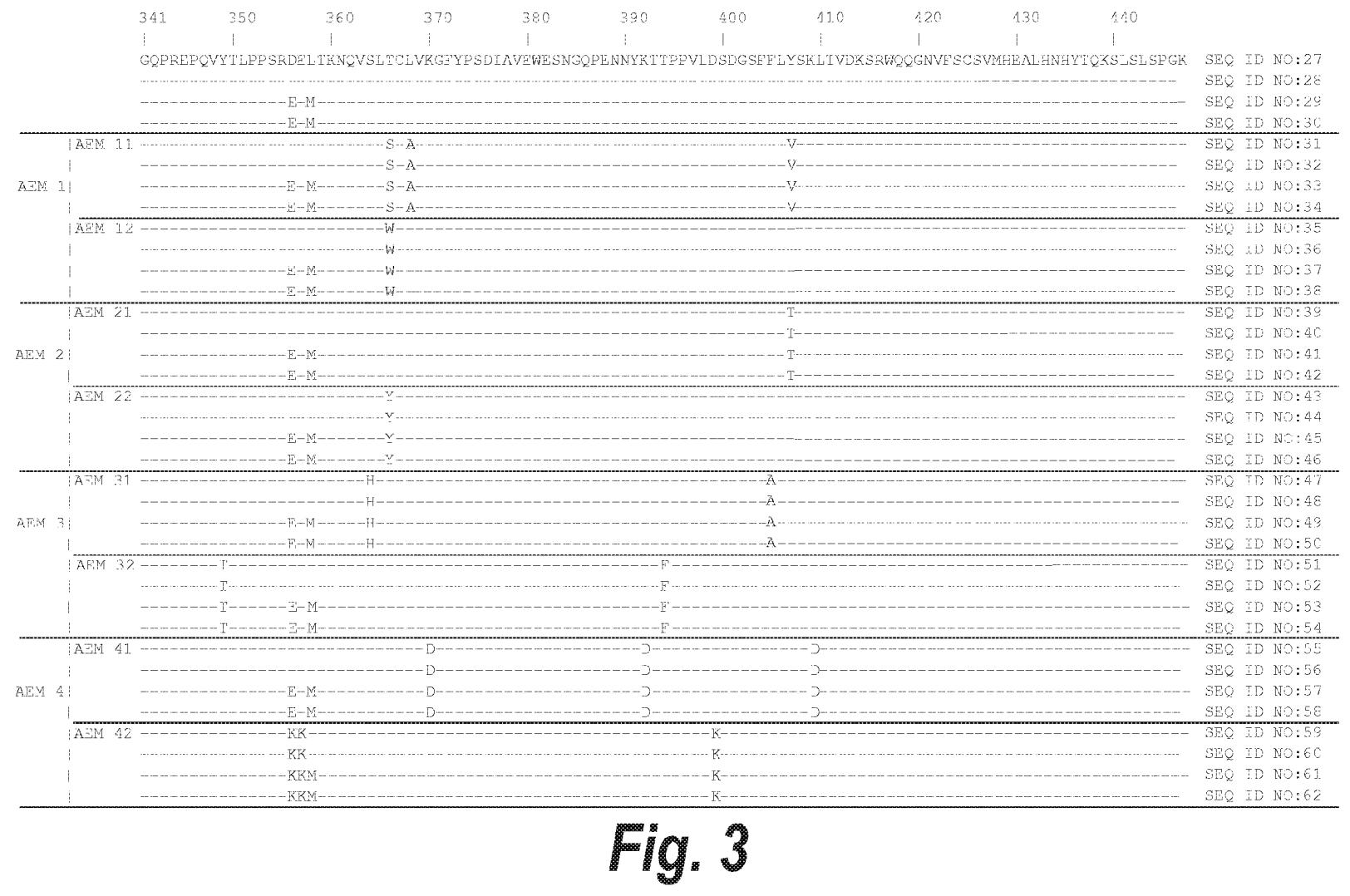

```
                341      350       360       370       380       390       400       410       420       430       440
                |        |         |         |         |         |         |         |         |         |         |
                GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO:27
                ----------------------------------------------------------------------------------------------------- SEQ ID NO:28
                ---------------E-M----------------------------------------------------------------------------------- SEQ ID NO:29
                ---------------E-M----------------------------------------------------------------------------------- SEQ ID NO:30
      |AEM 11   -------------------------S-A--------------------------------------V---------------------------------- SEQ ID NO:31
      |         -------------------------S-A--------------------------------------V---------------------------------- SEQ ID NO:32
AEM 1 |         ---------------E-M-------S-A--------------------------------------V---------------------------------- SEQ ID NO:33
      |         ---------------E-M-------S-A--------------------------------------V---------------------------------- SEQ ID NO:34
      |AEM 12   -------------------------W--------------------------------------------------------------------------- SEQ ID NO:35
      |         -------------------------W--------------------------------------------------------------------------- SEQ ID NO:36
      |         ---------------E-M-------W--------------------------------------------------------------------------- SEQ ID NO:37
      |         ---------------E-M-------W--------------------------------------------------------------------------- SEQ ID NO:38
      |AEM 21   ------------------------------------------------------------------T---------------------------------- SEQ ID NO:39
      |         ------------------------------------------------------------------T---------------------------------- SEQ ID NO:40
AEM 2 |         ---------------E-M------------------------------------------------T---------------------------------- SEQ ID NO:41
      |         ---------------E-M------------------------------------------------T---------------------------------- SEQ ID NO:42
      |AEM 22   -------------------------Y--------------------------------------------------------------------------- SEQ ID NO:43
      |         -------------------------Y--------------------------------------------------------------------------- SEQ ID NO:44
      |         ---------------E-M-------Y--------------------------------------------------------------------------- SEQ ID NO:45
      |         ---------------E-M-------Y--------------------------------------------------------------------------- SEQ ID NO:46
      |AEM 31   -----------------------H----------------------------------------A------------------------------------ SEQ ID NO:47
      |         -----------------------H----------------------------------------A------------------------------------ SEQ ID NO:48
AEM 3 |         ---------------E-M-----H----------------------------------------A------------------------------------ SEQ ID NO:49
      |         ---------------E-M-----H----------------------------------------A------------------------------------ SEQ ID NO:50
      |AEM 32   --------I--------------------------------------------F----------------------------------------------- SEQ ID NO:51
      |         --------I--------------------------------------------F----------------------------------------------- SEQ ID NO:52
      |         --------I------E-M-----------------------------------F----------------------------------------------- SEQ ID NO:53
      |         --------I------E-M-----------------------------------F----------------------------------------------- SEQ ID NO:54
      |AEM 41   -----------------------------D---------------------D----------------D-------------------------------- SEQ ID NO:55
      |         -----------------------------D---------------------D----------------D-------------------------------- SEQ ID NO:56
AEM 4 |         ---------------E-M-----------D---------------------D----------------D-------------------------------- SEQ ID NO:57
      |         ---------------E-M-----------D---------------------D----------------D-------------------------------- SEQ ID NO:58
      |AEM 42   ---------------KK-----------------------------------------K------------------------------------------ SEQ ID NO:59
      |         ---------------KK-----------------------------------------K------------------------------------------ SEQ ID NO:60
      |         ---------------KKM----------------------------------------K------------------------------------------ SEQ ID NO:61
      |         ---------------KKM----------------------------------------K------------------------------------------ SEQ ID NO:62
```

*Fig. 3*

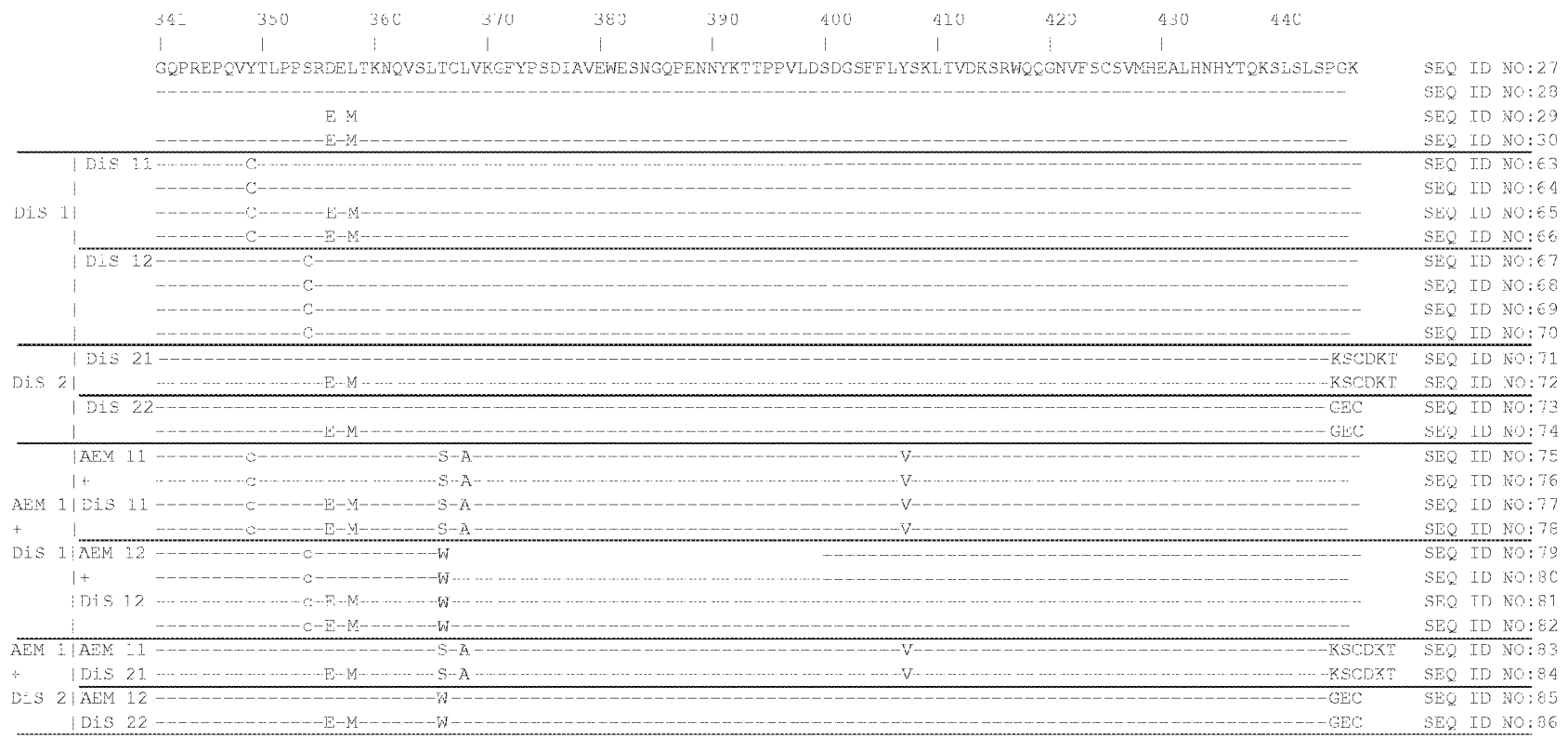

```
                 341      350         360         370         380         390         400         410         420         430         440
                 |        |           |           |           |           |           |           |           |           |           |
                 GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK       SEQ ID NO:27
                 -----------------------------------------------------------------------------------------------------------       SEQ ID NO:28
                                E M                                                                                                SEQ ID NO:29
                 ---------------E-M-----------------------------------------------------------------------------------------       SEQ ID NO:30
      | DiS 11 --------C--------------------------------------------------------------------------------------------------       SEQ ID NO:63
      |          --------C--------------------------------------------------------------------------------------------------       SEQ ID NO:64
DiS 1|           --------C------E-M-----------------------------------------------------------------------------------------       SEQ ID NO:65
      |          --------C------E-M-----------------------------------------------------------------------------------------       SEQ ID NO:66
      | DiS 12 -------------C---------------------------------------------------------------------------------------------       SEQ ID NO:67
      |          -------------C---------------------------------------------------------------------------------------------       SEQ ID NO:68
      |          -------------C---------------------------------------------------------------------------------------------       SEQ ID NO:69
      |          -------------C---------------------------------------------------------------------------------------------       SEQ ID NO:70
      | DiS 21 --------------------------------------------------------------------------------------------------------KSCDKT SEQ ID NO:71
DiS 2|           ---------------E-M-----------------------------------------------------------------------------------------KSCDKT SEQ ID NO:72
      | DiS 22 --------------------------------------------------------------------------------------------------------GEC    SEQ ID NO:73
      |          ---------------E-M-----------------------------------------------------------------------------------------GEC    SEQ ID NO:74
      |AEM 11  --------c----------------S-A--------------------------------------V----------------------------------------       SEQ ID NO:75
      |+         --------c----------------S-A--------------------------------------V----------------------------------------       SEQ ID NO:76
AEM 1|DiS 11   --------c------E-M-------S-A--------------------------------------V----------------------------------------       SEQ ID NO:77
+     |          --------c------E-M-------S-A--------------------------------------V----------------------------------------       SEQ ID NO:78
DiS 1|AEM 12   -------------c-----------W                                 ------------------------------------------------       SEQ ID NO:79
      |+         -------------c-----------W---------------------------------------------------------------------------------       SEQ ID NO:80
      |DiS 12    -------------c-E-M-------W---------------------------------------------------------------------------------       SEQ ID NO:81
      |          -------------c-E-M-------W---------------------------------------------------------------------------------       SEQ ID NO:82
AEM 1|AEM 11   -------------------------S-A--------------------------------------V-------------------------------------KSCDKT SEQ ID NO:83
+     |DiS 21    ---------------E-M-------S-A--------------------------------------V-------------------------------------KSCDKT SEQ ID NO:84
DiS 2|AEM 12   -------------------------W------------------------------------------------------------------------------GEC    SEQ ID NO:85
      |DiS 22    ---------------E-M-------W------------------------------------------------------------------------------GEC    SEQ ID NO:86
```

*Fig. 3*
(Cont'd)

```
              341      350       360       370       380       390       400       410       420       430       440
              |        |         |         |         |         |         |         |         |         |         |
              GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK      SEQ ID NO:27
              -----------------------------------------------------------------------------------------------------------      SEQ ID NO:28
              ---------------E-M-----------------------------------------------------------------------------------------      SEQ ID NO:29
              ---------------E-M-----------------------------------------------------------------------------------------      SEQ ID NO:30
AEM 1 |AEM 11-------------------------S-A--------------------------------------V-------------------------------------GEC         SEQ ID NO:87
+     |DiS 22---------------E-M-------S-A--------------------------------------V-------------------------------------GEC         SEQ ID NO:88
DiS 2 |AEM 12-------------------------W------------------------------------------------------------------------------KSCDKT      SEQ ID NO:89
      |DiS 21---------------E-M-------W------------------------------------------------------------------------------KSCDKT      SEQ ID NO:90
AEM 3 |AEM 31-----------------------H----------------------------------------A---------------------------------------KSCDKT      SEQ ID NO:91
+     |DiS 21---------------E-M-----H----------------------------------------A---------------------------------------KSCDKT      SEQ ID NO:92
DiS 2 |AEM 32--------T--------------------------------------------F--------------------------------------------------GEC         SEQ ID NO:93
      |DiS 22--------T------E-M-----------------------------------F--------------------------------------------------GEC         SEQ ID NO:94
AEM 4 |AEM 41-----------------------------D---------------------D----------------D-----------------------------------KSCDKT      SEQ ID NO:95
+     |DiS 21---------------E-M-----------D---------------------D----------------D-----------------------------------KSCDKT      SEQ ID NO:96
DiS 2 |AEM 42---------------KK-----------------------------------------K---------------------------------------------GEC         SEQ ID NO:97
      |DiS 22---------------KKM----------------------------------------K---------------------------------------------GEC         SEQ ID NO:98
```

Fig. 3
(Cont'd)

```
       220       230       240       250       260       270       280       290       300       310       320       330
         |         |         |         |         |         |         |         |         |         |         |         |
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPI   SEQ ID NO:99
          -----------------------------------------------------------------------------------------------------------   SEQ ID NO:100
---------------------------------------------------------------------------------------------------------------------   SEQ ID NO:101
          -----------------------------------------------------------------------------------------------------------   SEQ ID NO:102
---------------------------------------------------------------------------------------------------------------------   SEQ ID NO:103
          -----------------------------------------------------------------------------------------------------------   SEQ ID NO:104
---------------------------------------------------------------------------------------------------------------------   SEQ ID NO:105
          -----------------------------------------------------------------------------------------------------------   SEQ ID NO:106
---------------------------------------------------------------------------------------------------------------------   SEQ ID NO:107
          -----------------------------------------------------------------------------------------------------------   SEQ ID NO:108
---------------------------------------------------------------------------------------------------------------------   SEQ ID NO:109
          -----------------------------------------------------------------------------------------------------------   SEQ ID NO:110
---------------------------------------------------------------------------------------------------------------------   SEQ ID NO:111
          -----------------------------------------------------------------------------------------------------------   SEQ ID NO:112
--------CC-----------------------------------------------------------------------------------------------------------   SEQ ID NO:113
          -----------------------------------------------------------------------------------------------------------   SEQ ID NO:114
-------C-------------------------------------------------------------------------------------------------------------   SEQ ID NO:115
          -----------------------------------------------------------------------------------------------------------   SEQ ID NO:116
---------------------------------------------------------------------------------------------------------------------   SEQ ID NO:117
          -----------------------------------------------------------------------------------------------------------   SEQ ID NO:118
---------------------------------------------------------------------------------------------------------------------   SEQ ID NO:119
          -----------------------------------------------------------------------------------------------------------   SEQ ID NO:120
---------------------------------------------------------------------------------------------------------------------   SEQ ID NO:121
          -----------------------------------------------------------------------------------------------------------   SEQ ID NO:122
---------------------------------------------------------------------------------------------------------------------   SEQ ID NO:123
          -----------------------------------------------------------------------------------------------------------   SEQ ID NO:124
---------------------------------------------------------------------------------------------------------------------   SEQ ID NO:125
          -----------------------------------------------------------------------------------------------------------   SEQ ID NO:126
---------------------------------------------------------------------------------------------------------------------   SEQ ID NO:127
          -----------------------------------------------------------------------------------------------------------   SEQ ID NO:128
---------------------------------------------------------------------------------------------------------------------   SEQ ID NO:129
          -----------------------------------------------------------------------------------------------------------   SEQ ID NO:130
---------------------------------------------------------------------------------------------------------------------   SEQ ID NO:131
          -----------------------------------------------------------------------------------------------------------   SEQ ID NO:132
```

Fig. 4

| | 340 | 350 | 360 | 370 | 380 | 390 | 400 | 410 | 420 | 430 | 440 | |
|---|---|---|---|---|---|---|---|---|---|---|---|---|
| | EKTISKAKGQPREPQVYTLPPSREEMTKNQVSLTCLVKGFYPSDIAVEWESNGQPENYKTTPPVLDSDGSFFLYSKLTVDKSRWQQGNVFSCSVMHEALHNHYTQKSLSLSPGK | | | | | | | | | | | SEQ ID NO:99 |
| | | | | | | | | | | | | SEQ ID NO:100 |
| | | | | | | | | | | | | SEQ ID NO:101 |
| | | | | | | | | | | | | SEQ ID NO:102 |
| | | | | | | | | | | | | SEQ ID NO:103 |
| | | | | S-A | | | V | | | | | SEQ ID NO:104 |
| | | | | W | | | | | | | | SEQ ID NO:105 |
| | | | | S-A | | | V | | | | | SEQ ID NO:106 |
| | | | C | S-A | | | V | | | | | SEQ ID NO:107 |
| | | | C | W | | | | | | | | SEQ ID NO:108 |
| | | | | S-A | | | V | | | | | SEQ ID NO:109 |
| | | | C | W | | | T | | | | | SEQ ID NO:110 |
| | | | | V | | | V | | | | | SEQ ID NO:111 |
| | | | | Y | | | J | | | | | SEQ ID NO:112 |
| | | | | S-A | | | V | | | | | SEQ ID NO:113 |
| | | | | W | | | V | | | | | SEQ ID NO:114 |
| | | | | S-A | | | V | | | | | SEQ ID NO:115 |
| | | | | W | | | V | | | | | SEQ ID NO:116 |
| | | | | S-A | | | V | | | | KSCDKT | SEQ ID NO:117 |
| | | | | W | | | | | | | GEC | SEQ ID NO:118 |
| | | | | W | | | V | | | | GEC | SEQ ID NO:119 |
| | | | | S-A | | | V | | | | KSCDKT | SEQ ID NO:120 |
| | | | | S-A | | | V | | | | GEC | SEQ ID NO:21 |
| | | | | | | | | | | | KSCDKT | SEQ ID NO:122 |
| | | | | | | | A | | | | KSCDKT | SEQ ID NO:123 |
| | | | | | | F | | | | | GEC | SEQ ID NO:124 |
| | | | | | | F | A | | | | KSCDKT | SEQ ID NO:125 |
| | | | | | | | | | | | GEC | SEQ ID NO:126 |
| | | | | H | | D | D | | | | GEC | SEQ ID NO:127 |
| | T | | | | | | | | | | KSCDKT | SEQ ID NO:128 |
| | T | | KK | | | K | D | | | | KSCDKT | SEQ ID NO:129 |
| | | | KK | | | K | | | | | GEC | SEQ ID NO:130 |
| | | | | | | | | | | | GEC | SEQ ID NO:131 |
| | | | | H | | D | D | | | | KSCDKT | SEQ ID NO:132 |

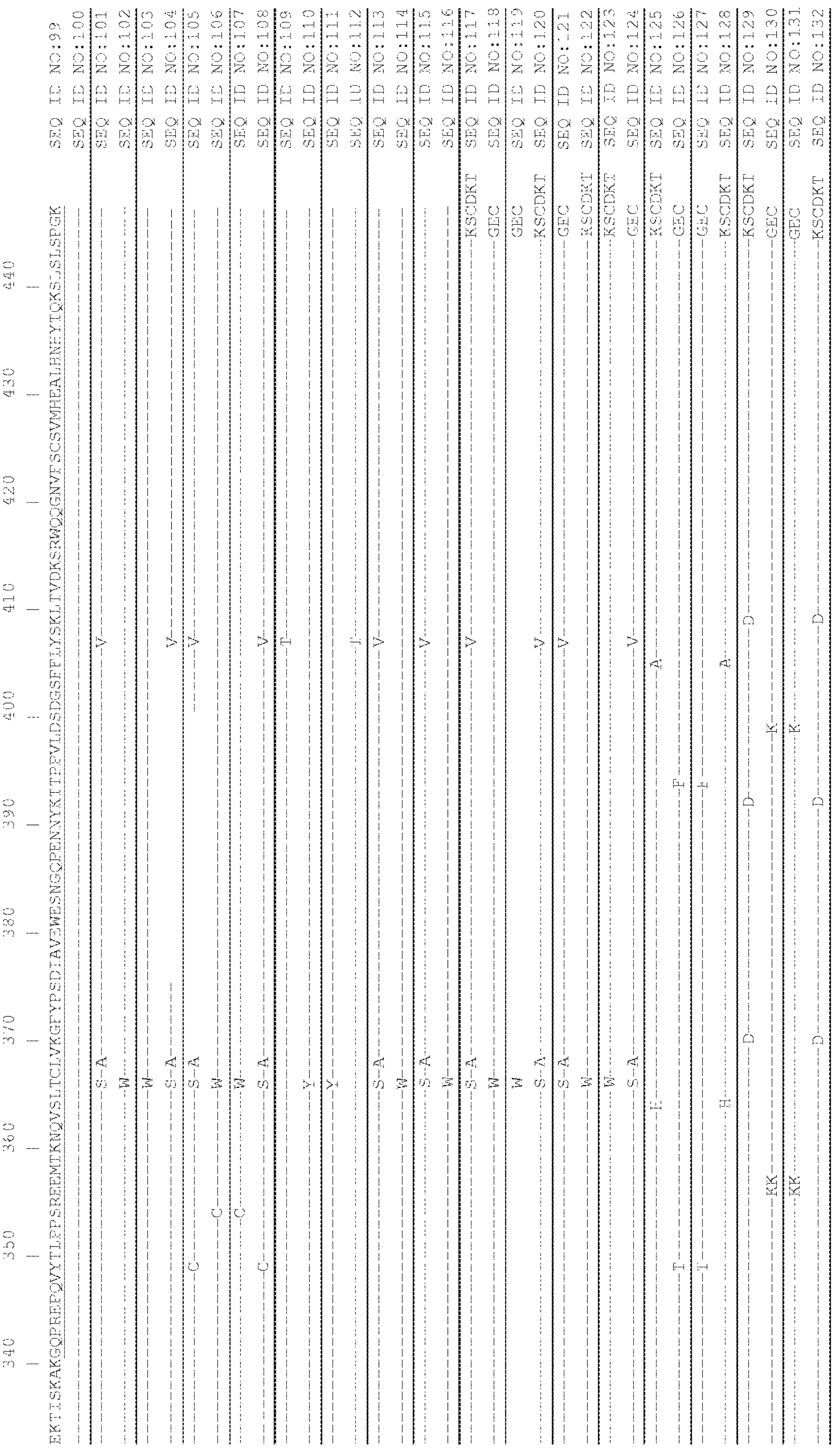

Fig. 4 (Cont'd)

```
220       230       240       250       260       270       280       290       300       310       320       330
|         |         |         |         |         |         |         |         |         |         |         |
EPKSCDKTHTcpscpapeflggpsvflfppkpkdtlmisrtpevtcvvvdvsqedpevqfnwyvdgvevhnaktkpreeqfAsKyrvvsvltvlhqdwlngkeykckvsnkglpssi SEQ ID NO:133
          ----------------------------------------------------------------------------------------------------------- SEQ ID NO:134
--------------------------------------------------------------------------------------------------------------------- SEQ ID NO:135
          ----------------------------------------------------------------------------------------------------------- SEQ ID NO:136
--------------------------------------------------------------------------------------------------------------------- SEQ ID NO:137
          ----------------------------------------------------------------------------------------------------------- SEQ ID NO:138
--------------------------------------------------------------------------------------------------------------------- SEQ ID NO:139
          ----------------------------------------------------------------------------------------------------------- SEQ ID NO:140
--------------------------------------------------------------------------------------------------------------------- SEQ ID NO:141
          ----------------------------------------------------------------------------------------------------------- SEQ ID NO:142
--------------------------------------------------------------------------------------------------------------------- SEQ ID NO:143
          ----------------------------------------------------------------------------------------------------------- SEQ ID NO:144
--------------------------------------------------------------------------------------------------------------------- SEQ ID NO:145
          ----------------------------------------------------------------------------------------------------------- SEQ ID NO:146
--------CC----------------------------------------------------------------------------------------------------------- SEQ ID NO:147
          ----------------------------------------------------------------------------------------------------------- SEQ ID NO:148
-------C------------------------------------------------------------------------------------------------------------- SEQ ID NO:149
          ----------------------------------------------------------------------------------------------------------- SEQ ID NO:150
--------------------------------------------------------------------------------------------------------------------- SEQ ID NO:151
          ----------------------------------------------------------------------------------------------------------- SEQ ID NO:152
--------------------------------------------------------------------------------------------------------------------- SEQ ID NO:153
          ----------------------------------------------------------------------------------------------------------- SEQ ID NO:154
--------------------------------------------------------------------------------------------------------------------- SEQ ID NO:155
          ----------------------------------------------------------------------------------------------------------- SEQ ID NO:156
--------------------------------------------------------------------------------------------------------------------- SEQ ID NO:157
          ----------------------------------------------------------------------------------------------------------- SEQ ID NO:158
--------------------------------------------------------------------------------------------------------------------- SEQ ID NO:159
          ----------------------------------------------------------------------------------------------------------- SEQ ID NO:160
--------------------------------------------------------------------------------------------------------------------- SEQ ID NO:161
          ----------------------------------------------------------------------------------------------------------- SEQ ID NO:162
--------------------------------------------------------------------------------------------------------------------- SEQ ID NO:163
          ----------------------------------------------------------------------------------------------------------- SEQ ID NO:164
--------------------------------------------------------------------------------------------------------------------- SEQ ID NO:165
          ----------------------------------------------------------------------------------------------------------- SEQ ID NO:166
```

Fig. 5

```
         340       350       360       370       380       390       400       410       420       430       440
          |         |         |         |         |         |         |         |         |         |         |
ektiskakGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK        SEQ ID NO:133
---------------------------------------------------------------------------------------------------------------        SEQ ID NO:134
----------------------------S-A------------------------------V-----------------------------------------------        SEQ ID NO:135
----------------------------W----------------------------------------------------------------------------------        SEQ ID NO:136
----------------------------W----------------------------------------------------------------------------------        SEQ ID NO:137
----------------------------S-A------------------------------V-----------------------------------------------        SEQ ID NO:138
-----------C----------------S-A------------------------------V-----------------------------------------------        SEQ ID NO:139
---------------C------------W----------------------------------------------------------------------------------        SEQ ID NO:140
---------------C------------W----------------------------------------------------------------------------------        SEQ ID NO:141
-----------C----------------S-A------------------------------V-----------------------------------------------        SEQ ID NO:142
-------------------------------------------------------------T-----------------------------------------------        SEQ ID NO:143
----------------------------Y----------------------------------------------------------------------------------        SEQ ID NO:144
----------------------------Y----------------------------------------------------------------------------------        SEQ ID NO:145
-------------------------------------------------------------T-----------------------------------------------        SEQ ID NO:146
----------------------------S-A------------------------------V-----------------------------------------------        SEQ ID NO:147
----------------------------W----------------------------------------------------------------------------------        SEQ ID NO:148
----------------------------S-A------------------------------V-----------------------------------------------        SEQ ID NO:149
----------------------------W----------------------------------------------------------------------------------        SEQ ID NO:150
----------------------------S-A------------------------------V---------------------------------------KSCDKT        SEQ ID NO:151
----------------------------W----------------------------------------------------------------------GEC        SEQ ID NO:152
----------------------------W----------------------------------------------------------------------GEC        SEQ ID NO:153
----------------------------S-A------------------------------V---------------------------------------KSCDKT        SEQ ID NO:154
----------------------------S-A------------------------------V---------------------------------------GEC        SEQ ID NO:155
----------------------------W----------------------------------------------------------------------KSCDKT        SEQ ID NO:156
----------------------------W----------------------------------------------------------------------KSCDKT        SEQ ID NO:157
----------------------------S-A------------------------------V---------------------------------------GEC        SEQ ID NO:158
--------------------------H-------------------------------A------------------------------------------KSCDKT        SEQ ID NO:159
-----------T----------------------------------------F------------------------------------------------GEC        SEQ ID NO:160
-----------T----------------------------------------F------------------------------------------------GEC        SEQ ID NO:161
--------------------------H-------------------------------A------------------------------------------KSCDKT        SEQ ID NO:162
------------------------------D---------------------D----------------D-------------------------------KSCDKT        SEQ ID NO:163
-----------------KK------------------------------------K---------------------------------------------GEC        SEQ ID NO:164
-----------------KK------------------------------------K---------------------------------------------GEC        SEQ ID NO:165
------------------------------D---------------------D----------------D-------------------------------KSCDKT        SEQ ID NO:166
```

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKP
KDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:171)

23A: Y349C/T366S/L368A/Y407V::S354C/T366W

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKP
KDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPRE
PQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:173)

23B: Y407T::T366Y

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLT
VDKSRWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKP
KDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPRE
PQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:175)

EPKSCDKTCCCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKP
KDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:177)

23D: T223C/T366S/L368A/Y407V::T366W

EPKSCDKCHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKP
KDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:179)

23E: T366S/L368A/Y407V/CH3 C-terminal Cysteine KSCDKT::T366W/CH3 C-terminal Cysteine GEC EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFP
PKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQ
PREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKS
LSLSGEC
(SEQ ID NO:181)

Fig. 6
(Cont'd)

23F: T366S/L368A/Y407V::T366W and (G4S)4

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGS*CPPCPAPELLGGPSVFLFPPKPKDTLMISRTPEVTCVVVDVS
HEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSL
WCLVKGFYPSDIAVEWESNGQPENNYKTTPPVLDSDGSFFLYSKLTVDKSRWQQGNVFSCSVMHEALHNHYTQKSLSLSPGK
(SEQ ID NO:183)

23E (35L): T366S/L368A/Y407V/CH3 C-terminal Cysteine KSCDKT::T366W/CH3 C-terminal Cysteine GEC and (G4S)7

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**KSCDKT*GGGGSGGGGSGGGGSGGGGSGGGGSGGGGSGGGGS***CPPCPAPELLGGPSVFLFPPKPKD
TLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQ
VYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSG
EC
(SEQ ID NO:185)

23E (35L) Inverted: T366S/L368A/Y407V/CH3 C-terminal Cysteine GEC::T366W/CH3 C-terminal Cysteine KSCDKT and (G4S)7

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**GEC*GGGGSGGGGSGGGGSGGGGSGGGGSGGGGSGGGGS***CPPCPAPELLGGPSVFLFPPKPKDTLM
ISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYT
LPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCD
KT
(SEQ ID NO:187)

*Fig. 6*
(Cont'd)

23E (30L): T366S/L368A/Y407V/CH3 C-terminal Cysteine KSCDKT::T366W/CH3 C-terminal Cysteine GEC and (G4S)6

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSKSCDKT*GGGGSGGGGSGGGGSGGGGSGGGGSGGGGS*CPPCPAPELLGGPSVFLFPPKPKDTLMIS
RTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLP
PSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:189)

23E (25L): T366S/L368A/Y407V/CH3 C-terminal Cysteine KSCDKT:: T366W/CH3 C-terminal Cysteine GEC and (G4S)5

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSKSCDKT*GGGGSGGGGSGGGGSGGGGSGGGGS*CPPCPAPELLGGPSVFLFPPKPKDTLMISRTPEV
TCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREE
MTKNQVSLWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:191)

23I: S364H/F405A::Y349T/T394F with CH3 terminal disulfide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVHLTCLVKGFYPSDIAVEWESNGQPENNYKTTPPVLDSDGSFALYSKLT
VDKSRWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFP
PKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQ
PREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKS
LSLSGEC
(SEQ ID NO:193)

*Fig. 6*
(Cont'd)

23J: K370D/K392D/K409D::D356K/E357K/D399K with CH3 terminal disulfide

EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDW
LNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLT
VDKSRWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFP
PKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQ
PREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKS
LSLSGEC

(SEQ ID NO:195)

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGKGGGGSGGGGSGGGGSGGGGSGGGGSGGGGSGGGGSGGGGScpscpapeflggpsvflfppkp
kdtlmisrtpevtcvvvdvsqedpevqfnwyvdgvevhnaktkpreeqfnskyrvvsvltvlhqdwlngkeykckvsnkglpssiektiskakGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:197)

39A: Y349C/T366S/L368A/Y407V::S354C/T366W

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVCTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGKGGGGSGGGGSGGGGSGGGGSGGGGSGGGGSGGGGSGGGGScpscpapeflggpsvflfppkp
kdtlmisrtpevtcvvvdvsqedpevqfnwyvdgvevhnaktkpreeqfnskyrvvsvltvlhqdwlngkeykckvsnkglpssiektiskakGQPRE
PQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:199)

39B: Y407T::T366Y

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLTCLVKGFYPSDIAVEWESNGQPENNYKTTPPVLDSDGSFFLTSKLT
VDKSRWQQGNVFSCSVMHEALHNHYTQKSLSLSPGKGGGGSGGGGSGGGGSGGGGSGGGGSGGGGSGGGGSGGGGScpscpapeflggpsvflfppkp
kdtlmisrtpevtcvvvdvsqedpevqfnwyvdgvevhnaktkpreeqfnskyrvvsvltvlhqdwlngkeykckvsnkglpssiektiskakGQPRE
PQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:201)

EPKSCDKTCCcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*cpscpapeflggpsvflfppkp
kdtlmisrtpevtcvvvdvsqedpevqfnwyvdgvevhnaktkpreeqfnskyrvvsvltvlhqdwlngkeykckvsnkglpssiektiskakGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:203)

39D: T223C/T366S/L368A/Y407V::T366W

EPKSCDKCHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGSGGGGSGGGGSGGGGSGGGGS*cpscpapeflggpsvflfppkp
kdtlmisrtpevtcvvvdvsqedpevqfnwyvdgvevhnaktkpreeqfnskyrvvsvltvlhqdwlngkeykckvsnkglpssiektiskakGQPRE
PQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSL
SPGK
(SEQ ID NO:205)

39E: T366S/L368A/Y407V/CH3 C-terminal Cysteine KSCDKT::T366W/CH3 C-terminal Cysteine GEC EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSKSCDKT*GGGGSGGGGSGGGGSGGGGSGGGGSGGGGSGGGGSGGGGS*cpscpapeflggpsvflfp
pkpkdtlmisrtpevtcvvvdvsqedpevqfnwyvdgvevhnaktkpreeqfnskyrvvsvltvlhqdwlngkeykckvsnkglpssiektiskakGQ
PREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKS
LSLSGEC
(SEQ ID NO:207)

*Fig. 7*
(Cont'd)

39F: T366S/L368A/Y407V::T366W and (G4S)4

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLSPGK*GGGGSGGGGSGGGGSGGGGS*cpscpapeflggpsvflfppkpkdtlmisrtpevtcvvvdvs
qedpevqfnwyvdgvevhnaktkpreeqfnskyrvvsvltvlhqdwlngkeykckvsnkglpssiektiskakGQPREPQVYTLPPSREEMTKNQVSL
WCLVKGFYPSDIAVEWESNGQPENNYKTTPPVLDSDGSFFLYSKLTVDKSRWQQGNVFSCSVMHEALHNHYTQKSLSLSPGK
(SEQ ID NO:209)

39E (35L): T366S/L368A/Y407V/CH3 C-terminal Cysteine KSCDKT::T366W/CH3 C-terminal Cysteine GEC and (G4S)7

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakgQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**KSCDKT*GGGGSGGGGSGGGGSGGGGSGGGGSGGGGSGGGGS***cpscpapeflggpsvflfppkpkd
tlmisrtpevtcvvvdvsqedpevqfnwyvdgvevhnaktkpreeqfnskyrvvsvltvlhqdwlngkeykckvsnkglpssiektiskakGQPREPQ
VYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSG
EC
(SEQ ID NO:211)

39E (35L) Inverted: T366S/L368A/Y407V/CH3 C-terminal Cysteine GEC::T366W/CH3 C-terminal Cysteine KSCDKT and (G4S)7

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**GEC*GGGGSGGGGSGGGGSGGGGSGGGGSGGGGSGGGGS***cpscpapeflggpsvflfppkpkdtlm
isrtpevtcvvvdvsqedpevqfnwyvdgvevhnaktkpreeqfnskyrvvsvltvlhqdwlngkeykckvsnkglpssiektiskakGQPREPQVYT
LPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCD
KT
(SEQ ID NO:213)

*Fig. 7*
(Cont'd)

39E (30L): T366S/L368A/Y407V/CH3 C-terminal Cysteine KSCDKT::T366W/CH3 C-terminal Cysteine GEC and (G4S)6

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**KSCDKT*GGGGSGGGGSGGGGSGGGGSGGGGSGGGGS***cpscpapeflggpsvflfppkpkdtlmis
rtpevtcvvvdvsqedpevqfnwyvdgvevhnaktkpreeqfnskyrvvsvltvlhqdwlngkeykckvsnkglpssiektiskakGQPREPQVYTLP
PSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:215)

39E (25L): T366S/L368A/Y407V/CH3 C-terminal Cysteine KSCDKT::T366W/CH3 C-terminal Cysteine GEC and (G4S)5

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLSCAVKGFYPSDIAVEWESNGQPENNYKTTPPVLDSDGSFFLVSKLT
VDKSRWQQGNVFSCSVMHEALHNHYTQKSLSLS**KSCDKT*GGGGSGGGGSGGGGSGGGGSGGGGS***cpscpapeflggpsvflfppkpkdtlmisrtpev
tcvvvdvsqedpevqfnwyvdgvevhnaktkpreeqfnskyrvvsvltvlhqdwlngkeykckvsnkglpssiektiskakGQPREPQVYTLPPSREE
MTKNQVSLWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:217)

39I - S364H/F405A::Y349T/T394F with CH3 C-terminal disulfide
EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVHLTCLVKGFYPSDIAVEWESNGQPENNYKTTPPVLDSDGSFALYSKLT
VDKSRWQQGNVFSCSVMHEALHNHYTQKSLSLSKSCDKT*GGGGSGGGGSGGGGSGGGGSGGGGSGGGGSGGGGSGGGGS*cpscpapeflggpsvflfp
pkpkdtlmisrtpevtcvvvdvsqedpevqfnwyvdgvevhnaktkpreeqfnskyrvvsvltvlhqdwlngkeykckvsnkglpssiektiskakGQ
PREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKS
LSLSGEC
(SEQ ID NO:219)

Fig. 7
(Cont'd)

39J – K370D/K392D/K409D::E356K/E357K/D399K with CH3 C-terminal disulfide

EPKSCDKTHTcpscpapeflggpsvflfppkpkdtlmisrtpevtcvvvdvsqedpevqfnwyvdgvevhnaktkpreeqfnskyrvvsvltvlhqdw
lngkeykckvsnkglpssiektiskakGQPREPQVYTLPPSREEMTKNQVSLTCLVDGFYPSDIAVEWESNGQPENNYDTTPPVLDSDGSFFLYSDLT
VDKSRWQQGNVFSCSVMHEALHNHYTQKSLSLSKSCDKT*GGGGSGGGGSGGGGSGGGGSGGGGSGGGGSGGGGSGGGGS*cpscpapeflggpsvflfp
pkpkdtlmisrtpevtcvvvdvsqedpevqfnwyvdgvevhnaktkpreeqfnskyrvvsvltvlhqdwlngkeykckvsnkglpssiektiskakGQ
PREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKS
LSLSGEC
(SEQ ID NO:221)

Fig. 7
(Cont'd)

HEAVY CHAINS:

A) Anti-c-Met/anti-EGFR TFcBA with humanized 5D5 anti-c-Met and anti-EGFR paninumumab scFv with IgG1 TFc (with AEM 1 and DiS 2):

EVQLVESGGGLVQPGGSLRLSCAASGYTFTSYWLHWVRQAPCKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGG
GSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGECGGGGSGGGGSQVQLQESGPGLVKPSETLSLTCTVSGGSVSSGDYYWTWIRQSPGKGLEWIGHIYYSGNTN
YNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGD
RVTITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO:235)

B) Anti-c-Met/anti-EGFR TFcBA with humanized 5D5 anti-c-Met and anti-EGFR paninumumab scFv with IgG1 TFc (with AEM 1 and DiS 2 Inverted):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPPCPA
PELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALP
APIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSV
MHEALHNHYTQKSLSLSKSCDKTGGGGSGGGGSQVQLQESGPGLVKPSETLSLTCTVSGGSVSSGDYYWTWIRQSPGKGLEWIGHIYYSGNTNYNPSL
KSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTIT
CQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO: 343)

*Fig. 9*

C) Anti-c-Met/anti-EGFR TFcBA with humanized 5D5 anti-c-Met and anti-EGFR paninumumab scFv with IgG1 TFc (with AEM 1):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSPGK*GGGGSGGGGSGGGGSGGGGSGGGGSGGGGSGGGGSGGGGS*C
PPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVS
NKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNV
FSCSVMHEALHNHYTQKSLSLSPGK*GGGGSGGGGS*QVQLQESGPGLVKPSETLSLTCTVSGGSVSSGDYYWTWIRQSPGKGLEWIGHIYYSGNTNYNP
SLKSRLTISIDTSKTQFSLKLSSVTAADTAIYYCVRDRVTGAFDIWGQGTMVTSS*ASTGGGGSGGGGSGGGGSGGGGS*DIQMTQSPSSLSASVGDRVT
ITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO: 225)

D) Anti-c-Met/anti-EGFR TFcBA with humanized 5D5 anti-c-Met and anti-EGFR paninumumab scFv with IgG1/IgG4 hybrid TFc (with AEM 1):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTcpscpapeflggpsvflfppkpkdtlmisrtpevtcvvvdvsqedpevqfnwyvdgvevhnaktkpr
eeqfnskyrvvsvltvlhqdwlngkeykckvsnkglpssiektiskakGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSPGK*GGGGSGGGGSGGGGSGGGGSGGGGSGGGGSGGGGSGGGGS*c
pscpapeflggpsvflfppkpkdtlmisrtpevtcvvvdvsqedpevqfnwyvdgvevhnaktkpreeqfnskyrvvsvltvlhqdwlngkeykckvs
nkglpssiektiskakGQPREPQVYTLPPSREEMTKNQVSLWCLVKGFYPSDIAVEWESNGQPENNYKTTPPVLDSDGSFFLYSKLTVDKSRWQQGNV
FSCSVMHEALHNHYTQKSLSLSPGK*GGGGSGGGGS*QVQLQESGPGLVKPSETLSLTCTVSGGSVSSGDYYWTWIRQSPGKGLEWIGHIYYSGNTNYNP
SLKSRLTISIDTSKTQFSLKLSSVTAADTAIYYCVRDRVTGAFDIWGQGTMVTSS*ASTGGGGSGGGGSGGGGSGGGGS*DIQMTQSPSSLSASVGDRVT
ITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO: 227)

Fig. 9
(Cont'd)

E) Anti-c-Met/anti-EGFR TFcBA with humanized 5D5 anti-c-Met and anti-EGFR paninumumab scFv with IgG1/IgG4 hybrid TFc (with AEM 1):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTcpscpapeflggpsvflfppkpkdtlmisrtpevtcvvvdvsqedpevqfnwyvdgvevhnaktkpr
eeqfNsKyrvvsvltvlhqdwlngkeykckvsnkglpssiektiskakGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSc
pscpapeflggpsvflfppkpkdtlmisrtpevtcvvvdvsqedpevqfnwyvdgvevhnaktkpreeqfnskyrvvsvltvlhqdwlngkeykckvs
nkglpssiektiskakGQPREPQVYTLPPSREEMTKNQVSLWCLVKGFYPSDIAVEWESNGQPENNYKTTPPVLDSDGSFFLYSKLTVDKSRWQQGNV
FSCSVMHEALHNHYTQKSLSLSPGKGGGGSGGGGSQVQLQESGPGLVKPSETLSLTCTVSGGSVSSGDYYWTWIRQSPGKGLEWIGHIYYSGNTNYNP
SLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVT
ITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO: 229)

F) Anti-c-Met/anti-EGFR TFcBA with humanized 5D5 anti-c-Met and anti-EGFR scFv 2224 with IgG1 TFc (with AEM 1 and DiS 2):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGG
GSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGECGGGGSGGGGSEVQLVQSGAEVKKPGSSVKVSCKASGGTFSSYAIGWVRQAPGQGLEWMGGIIPIFGIANY
AQKFQGRVTITADESTSSAYMELSSLRSEDTAVYYCAREEGPYCSSTSCYAAFDIWGQGTLVTVSSASTGGGGSGGGGSGGGGSGGGGSQSVLTQDPA
VSVALGQTVKITCQGDSLRSYFASWYQQKPGQAPTLVMYARNDRPAGVPDRFSGSKSGTSASLAISGLQPEDEADYYCAAWDDSLNGYLFGAGTKLTV
L
(SEQ ID NO:239)

Fig. 9
(Cont'd)

G) Anti-c-Met/anti-EGFR TFcBA with humanized 5D5 anti-c-Met and humanized anti-EGFR cetuximab scFv H1 L1 with IgG1 TFc (with AEM 1 and DiS 2):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGG
GSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGECGGGGSGGGGSQVQLVESGGGVVQPGESLRLSCAvSGFSLTNYGVHWVRQAPGKGLEWVgVIWSGGNTDYN
TPFTSRFTISkDNSKNTvYLQMNSLRAEDTAVYYCARALTYYDYEFAYWGQGTLVTVSSASTGGGGSGGGGSGGGGSGGGGSdIVLTQSPDFQSVTPG
EKVTITCRASQSIGTNIHWYQQKPDQSPKLLIKYASESISGVPSRFSGSGSGTDFTLTINSLEAEDEATYYCQQNNNWPTTFGQGTKVEIKRT
(SEQ ID NO:260)

H) Anti-c-Met/anti-IGFR TFcBA with humanized 5D5 anti-c-Met and humanized anti-EGFR cetuximab scFv H1 L2 with IgG1 TFc (with AEM 1 and DiS 2):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGG
GSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGECGGGGSGGGGSQVQLVESGGGVVQPGESLRLSCAvSGFSLTNYGVHWVRQAPGKGLEWVgVIWSGGNTDYN
TPFTSRFTISkDNSKNTvYLQMNSLRAEDTAVYYCARALTYYDYEFAYWGQGTLVTVSSASTGGGGSGGGGSGGGGSGGGGSdIVLTQSPsslSVTPG
EKVTfTCRASQSIGTNIHWYQQKPgQSPKLLIKYASESISGVPSRFSGSGSGTDFTLTINSvEAEDEATYYCQQNNNWPTTFGQGTKlEIKRT
(SEQ ID NO:281)

*Fig. 9*
(Cont'd)

I) Anti-c-Met/anti-EGFR TFcBA with humanized 5D5 anti-c-Met and humanized anti-EGFR cetuximab scFv H2 L1 with IgG1 TFc (with AEM 1 and DiS 2):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKT*GGGGSGGGGSGGGGSGGGGSGGGGSGGGGSGGGGSGGG*
*GS*CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGEC*GGGGSGGGGS*QVQLVESGGGVVQPGESLRiSCAvSGFSLTNYGVHWVRQAPGKGLEWlgVIWSGGNTDYN
TPFTSRlTISkDNSKsTvYfQMNSLRAEDTAVYYCARALTYYDYEFAYWGQGTLVTVSS*ASTGGGGSGGGGSGGGGSGGGGS*dIVLTQSPDFQSVTPG
EKVTITCRASQSIGTNIHWYQQKPDQSPKLLIKYASESISGVPSRFSGSGSGTDFTLTINSLEAEDEATYYCQQNNNWPTTFGQGTKVEIKRT
(SEQ ID NO:283)

J) Anti-c-Met/anti-EGFR TFcBA with humanized 5D5 anti-c-Met and humanized anti-EGFR cetuximab scFv H2 L2 with IgG1 TFc (with AEM 1 and DiS 2):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSKSCDKT*GGGGSGGGGSGGGGSGGGGSGGGGSGGGGSGGGGSGGG*
*GS*CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKC
KVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQ
GNVFSCSVMHEALHNHYTQKSLSLSGEC*GGGGSGGGGS*QVQLVESGGGVVQPGESLRiSCAvSGFSLTNYGVHWVRQAPGKGLEWlgVIWSGGNTDYN
TPFTSRlTISkDNSKsTvYfQMNSLRAEDTAVYYCARALTYYDYEFAYWGQGTLVTVSS*ASTGGGGSGGGGSGGGGSGGGGS*dIVLTQSPsslSVTPG
EKVTfTCRASQSIGTNIHWYQQKPgQSPKLLIKYASESISGVPSRFSGSGSGTDFTLTINSvEAEDEATYYCQQNNNWPTTFGQGTKlEIKRT
(SEQ ID NO:285)

*Fig. 9*
(Cont'd)

K) Anti-c-Met/anti-EGFR TFcBA with anti-c-Met VH domain from anti-c-Met binding site 2 and humanized anti-EGFR cetuximab scFv H1 L1 with IgG1 TFc (with AEM 1 and DiS 2):

QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCAR
SEITTEFDYWGQGTLVTVSSASTKGPSVFPLAPSSKSTSGGTAALGCLVKDYFPEPVTVSWNSGALTSGVHTFPAVLQSSGLYSLSSVVTVPSSSLGT
QTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPRE
EQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNY
KTTPPVLDSDGSFFLVSKLTVDKSRWQQGNVFSCSVMHEALHNHYTQKSLSLSKSCDKT*GGGGSGGGGSGGGGSGGGGSGGGGSGGGGSGGGGSGGGG*
*S*CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCK
VSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQG
NVFSCSVMHEALHNHYTQKSLSLSGEC*GGGGSGGGGS*QVQLVESGGGVVQPGESLRLSCAvSGFSLTNYGVHWVRQAPGKGLEWVgVIWSGGNTDYNT
PFTSRFTISkDNSKNTvYLQMNSLRAEDTAVYYCARALTYYDYEFAYWGQGTLVTVSS*ASTGGGGSGGGGSGGGGSGGGGS*dIVLTQSPDFQSVTPGE
KVTITCRASQSIGTNIHWYQQKPDQSPKLLIKYASESISGVPSRFSGSGSGTDFTLTINSLEAEDEATYYCQQNNNWPTTFGQGTKVEIKRT
(SEQ ID NO:291)

L) Anti-c-Met/anti-EGFR TFcBA with humanized 5D5 anti-c-Met and anti-EGFR paninumumab scFv with IgG1 TFc (with AEM 1 and- 40 aa TFc linker):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPR
EEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSPGK*TRPAPPSTATTAGSTPQPESASPSGKEPAASSPSSTNTGS*C
PPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVS
NKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNV
FSCSVMHEALHNHYTQKSLSLSPGK*GGGGSGGGGS*QVQLQESGPGLVKPSETLSLTCTVSGGSVSSGDYYWTWIRQSPGKGLEWIGHIYYSGNTNYNP
SLKSRLTISIDTSKTQFSLKLSSVTAADTAIYYCVRDRVTGAFDIWGQGTMVTSS*ASTGGGGSGGGGSGGGGSGGGGS*DIQMTQSPSSLSASVGDRVT
ITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO:347)

Fig. 9
(Cont'd)

M) Anti-c-Met/anti-EGFR TFcBA with humanized 5D5 anti-c-Met and anti-EGFR paninumumab scFv with IgG1/IgG4 hybrid TFc (with AEM 1 and 40 aa TFc linker):

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCAR
YGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTcpscpapeflggpsvflfppkpkdtlmisrtpevtcvvvdvsqedpevqfnwyvdgvevhnaktkpr
eeqfNsKyrvvsvltvlhqdwlngkeykckvsnkglpssiektiskakGQPREPQVYTLPPSREEMTKNQVSLSCAVKGFYPSDIAVEWESNGQPENN
YKTTPPVLDSDGSFFLVSKLTVDKSRWQQGNVFSCSVMHEALHNHYTQKSLSLSPGK*TRPAPPSTATTAGSTPQPESASPSGKEPAASSPSSTNTGS*c
pscpapeflggpsvflfppkpkdtlmisrtpevtcvvvdvsqedpevqfnwyvdgvevhnaktkpreeqfnskyrvvsvltvlhqdwlngkeykckvs
nkglpssiektiskakGQPREPQVYTLPPSREEMTKNQVSLWCLVKGFYPSDIAVEWESNGQPENNYKTTPPVLDSDGSFFLYSKLTVDKSRWQQGNV
FSCSVMHEALHNHYTQKSLSLSPGK*GGGGSGGGGS*QVQLQESGPGLVKPSETLSLTCTVSGGSVSSGDYYWTWIRQSPGKGLEWIGHIYYSGNTNYNP
SLKSRLTISIDTSKTQFSLKLSSVTAADTAIYYCVRDRVTGAFDIWGQGTMVTSS*ASTGGGGSGGGGSGGGGSGGGGS*DIQMTQSPSSLSASVGDRVT
ITCQASQDISNYLNWYQQKPGKAPKLLIYDASNLETGVPSRFSGSGSGTDFTFTISSLQPEDEATYFCQHFDHLPLAFGGGTKVEIKRT
(SEQ ID NO:349)

Fig. 9
(Cont'd)

Nucleotide sequences encoding the polypeptides of Figure 6:

SEQ ID NO:170 (encodes SEQ ID NO:171):
gaaccgaaatcatgcgataagacccacacatgccctccctgtccagcacccgagctgctcggggaccctcggtgttcttgtttcctcccaaacccaa
agataccccttatgattagccggacaccagaggtgacgtgcgtggtagtagacgtgtcccatgaggacccggaggtcaagttcaactggtacgtggacg
gagtggaggtgcacaatgcaaagaccaagccgagggaagagcaataccagtccacatatagagtcgtgtcggtccttacggtcttgcatcaggactgg
ctgaatggcaaagaatacaaatgtaaagtctccaacaaagctctcccagcgcccattgagaaaacaatctcaaaagcgaaaggccaaccgagagaacc
tcaagtctatactcttcccccgtcgagagaggaaatgaccaaaaaccaggtatccctgtcatgcgcggtcaaggggttttacccaagcgacatcgccg
tggagtgggagtcgaacggacagccagagaataactataagacgacccctcccgtgctggattcggatggatcgttctttcttgtcagcaaactcaca
gtcgacaaatcaaggtggcagcaagggaacgtgttcagctgttcggtaatgcatgaagccctccacaatcactacacgcagaaatccctgtcgctctc
accagggaagggtgggggtggctcaggggggtgggggatcaggtggtggtggtagcggaggtggagggagcggaggcggaggctccggtggaggaggtt
ccggaggtggcgggtcaggggggaggagggtcatgtccgccgtgccctgcccccgaattgctgggaggtccgtccgtatttctgtttcccccgaagcct
aaagatactcttatgatctcgcgaacgccggaagtaacttgtgtcgtggtagatgtctcacacgaagatcccgaagtgaaattcaattggtatgtcga
cggcgtggaggtacataacgccaagacgaagcctagagaggaacagtaccagtcaacgtatcgggtcgtatccgtgctcaccgtgctccaccaggatt
ggctgaacggaaaggagtacaagtgcaaagtctcgaacaaggcgttgcctgcgccaatcgaaaagacgatctccaaagctaagggacaaccaagggaa
ccacaagtgtatactctcccgccctcgcgcgaagagatgacaaagaatcaggtgtcactttggtgcttggtgaaggggttctatccctcggatattgc
ggtcgagtgggagagcaatggtcaaccggagaacaattacaagacgacaccgcccgtattggactccgacgggtccttctttctctactcgaagctca
ctgtagataagtcgcgatggcagcaggggaacgtctttagctgttccgtgatgcacgaggcacttcataaccactatacccagaagtcgttgtcgctt
tcccccggaaaa SEQ ID NO:172 (encodes SEQ ID NO:173):
gaaccgaaatcatgcgataaaactcacacgtgccctccatgccctgctccggaacttctcggggggaccgtccgtattcctctttcctcctaagcctaa
ggacaccctcatgatcagcaggacccccgaggtgacgtgtgtagtcgtggatgtgtcccacgaggacccggaagtcaagttcaactggtatgtagatg
gagtggaggtccataatgccaagaccaagccaagagaggagcagtatcagtcgacttatcgggtggtcagcgtcctcacggtacttcatcaggattgg
ctgaatggaaaggagtacaaatgtaaggtatccaacaaagcgttgccagcgcccatcgaaaagacaatctcgaaggcgaagggacaaccccgggaacc
gcaagtgtgtaccctgccaccttcccgggaggagatgacgaaaaaccaggtatccctgtcgtgcgccgtgaaagggttttacccatcggatatcgcag
tggagtgggaaagcaatgggcagccggaaaacaactataagaccacgcccccctgtactcgactcggatgggtcctttttcctcgtcagcaaacttacg
gtagacaaaagcaggtggcaacaggggaatgtgttcagctgctcagtcatgcacgaggcactccataaccattacactcagaaatcactgtcgctgtc
gcccggtaaaggggggaggtgggtcgggcggtgggggaagcggtggtgggggatcaggtgggggaggttcgggaggtggtgggagcggtggaggcggtt
ccggaggaggcgggtcgggtggaggtggatcgtgcccaccgtgccccgcaccggaactccttggggggaccatccgtgtttctgtttccaccgaagcca
aaggacactctcatgatctcgcgcacaccagaggtgacatgtgtcgtcgtcgatgtgtcacacgaagatccagaggtcaagtttaactggtacgtgga
cggagtcgaggtccacaatgcgaaaacgaaacccagagaagagcagtaccagtcaacataccgggtggtgagcgtattgaccgtgcttcaccaggact
ggcttaacgggaaagagtacaagtgtaaggtcagcaataaggcgctcccagcgcctattgagaaaactatctcgaaagcaaaggggcagccacgagag
ccccaagtgtgtacgctgccaccctgtcgggaggaaatgaccaagaatcaagtctcgctttggtgccttgtgaaggattctatcccagcgacattgc
tgtagagtgggagtcgaacgggcaacccgagaataactacaagactactccgccggtgttggactcggacgggtcgttcttcctttatagcaaactca
cagtcgacaagtccagatggcagcagggaaatgtcttttcctgctcggtaatgcacgaagcgttgcataaccactatacacagaagtcgctttcgttg
tcacccgggaaa

Fig. 10

SEQ ID NO:174 (encodes SEQ ID NO:175):
gaaccgaaatcatgcgacaaaacgcacacttgtccgccgtgccctgccccagagttgcttggaggaccatcagtatttctcttccctcctaagccgaa
agacacactcatgatctcacgcacaccggaagtaacttgcgtggtggtggatgtgtcgcatgaagatcccgaggtcaaattcaactggtacgtcgacg
gtgtggaggtgcacaacgccaagacgaaacccagagaagagcagtatcagtcgacctaccgagtggtatccgtgcttacggtgctgcatcaggattgg
ttgaatggaaaagaatacaaatgcaaagtctcgaataaggcgctcccagccccaatcgaaaagacgatttccaaggcgaaggggcagcctcgggaacc
tcaggtctatacccttcctccgtcacgcgaggaaatgacaaagaatcaggtcagcctcacatgcctcgtgaagggattctatccgtcggatattgctg
tcgagtgggaatcgaacggacagcccgagaacaattacaaaacaactcctcccgtacttgactcggacgggagctttttccttacgtcaaagctgacc
gtcgataaaagcaggtggcagcaagggaatgtgttttcgtgctcggtcatgcacgaagcacttcataaccactacacccagaaatccttgagcctgtc
accggggaagggaggagggggtagcggcggtggagggagcggaggaggcgggtccggtgggggtgggtccgggggtggcggaagcggtggcggaggtt
cgggagggggaggaagcggagggggtggatcgtgtcctccgtgcccagcccccgaactcctcggggaccctcggtattcctttttccgccgaaaccc
aaggacactttgatgattagccggacgcccgaggtgacatgcgtggtcgtggatgtatcgcatgaggaccccgaagtgaagttcaattggtacgtgga
tggggtggaagtccataacgcaaagaccaagcccagagaggagcagtaccaatcgacgtatagggtcgtgtccgtcctcacagtcttgcaccaggact
ggttgaacgggaaggagtataagtgtaaggtcagcaacaaagcgttgcctgcgcccattgaaaagactatctcaaaagcaaagggacagcccagggag
ccccaagtgtacacactgcccccgtcaagagaagaaatgaccaaaaatcaagtgtccctctactgcttggtgaaggggttctatcccagcgacatcgc
ggtagagtgggagtcaaatggccagcccgaaaacaactacaaaacgacaccgcccgtgttggattcggatgggtcattctttctgtattcaaaactga
cagtggacaagtcgcggtggcaacaggggaacgtgttttcctgttccgtaatgcacgaggcgttgcacaatcactatacgcagaagtccctctcgctt
tcacccgggaag SEQ ID NO:176 (encodes SEQ ID NO:177):
gaaccgaaatcatgcgataagacttgctgctgtcctccctgtccagcacccgagctgctcggggaccctcggtgttcttgtttcctcccaaacccaa
agatacccttatgattagccggacaccagaggtgacgtgcgtggtagtagacgtgtcccatgaggacccggaggtcaagttcaactggtacgtggacg
gagtggaggtgcacaatgcaaagaccaagccgagggaagagcaataccagtccacatatagagtcgtgtcggtccttacggtcttgcatcaggactgg
ctgaatggcaaagaatacaaatgtaaagtctccaacaaagctctcccagcgcccattgagaaaacaatctcaaaagcgaaaggccaaccgagagaacc
tcaagtctatactcttcccccgtcgagagaggaaatgaccaaaaatcaggtatccctgtcatgcgcggtcaaggggttttacccaagcgacatcgccg
tggagtgggagtcgaacggacagccagagaataactataagacgacccctcccgtgctggattcggatggatcgttctttcttgtcagcaaactcaca
gtcgacaaatcaaggtggcagcaagggaacgtgttcagctgttcggtaatgcatgaagccctccacaatcactacacgcagaaatccctgtcgctctc
accagggaagggtgggggtggctcagggggtgggggatcaggtggtggtggtagcggaggtggagggagcggaggcggaggctccggtggaggaggtt
ccggaggtggcgggtcaggggggaggagggtcatgtccgccgtgccctgcccccgaattgctgggaggtccgtccgtatttctgtttcccccgaagcct
aaagatactcttatgatctcgcgaacgccggaagtaacttgtgtcgtggtagatgtctcacacgaagatcccgaagtgaaattcaattggtatgtcga
cggcgtggaggtacataacgccaagacgaagcctagagaggaacagtaccagtcaacgtatcgggtcgtatccgtgctcaccgtgctccaccaggatt
ggctgaacggaaaggagtacaagtgcaaagtctcgaacaaggcgttgcctgcgccaatcgaaaagacgatctccaaagctaagggacaaccaaggga a
ccacaagtgtatactctcccgccctcgcgcgaagagatgacaaagaatcaggtgtcactttggtgcttggtgaaggggttctatccctcggatattgc
ggtcgagtgggagagcaatggtcaaccggagaacaattacaagacgacaccgcccgtattggactccgacgggtccttctttctctactcgaagctca
ctgtagataagtcgcgatggcagcaggggaacgtctttagctgttccgtgatgcacgaggcacttcataaccactatacccagaagtcgttgtcgctt
tcccccggaaaa

*Fig. 10*
(Cont'd)

SEQ ID NO:178 (encodes SEQ ID NO:179):
gaaccgaaatcatgcgataagtgccacacatgccctccctgtccagcacccgagctgctcggggaccctcggtgttcttgtttcctcccaaacccaa
agatacccttatgattagccggacaccagaggtgacgtgcgtggtagtagacgtgtcccatgaggacccggaggtcaagttcaactggtacgtggacg
gagtggaggtgcacaatgcaaagaccaagccgagggaagagcaataccagtccacatatagagtcgtgtcggtccttacggtcttgcatcaggactgg
ctgaatggcaaagaatacaaatgtaaagtctccaacaaagctctcccagcgcccattgagaaaacaatctcaaaagcgaaaggccaaccgagagaacc
tcaagtctatactcttcccccgtcgagagaggaaatgaccaaaaaccaggtatccctgtcatgcgcggtcaaggggttttacccaagcgacatcgccg
tggagtgggagtcgaacggacagccagagaataactataagacgacccctcccgtgctggattcggatggatcgttctttcttgtcagcaaactcaca
gtcgacaaatcaaggtggcagcaagggaacgtgttcagctgttcggtaatgcatgaagccctccacaatcactacacgcagaaatccctgtcgctctc
accagggaagggtgggggtggctcaggggggtgggggatcaggtggtggtggtagcggaggtggagggagcggaggcggaggctccggtggaggaggtt
ccggaggtggcgggtcagggggaggagggtcatgtccgccgtgccctgccccgaattgctgggaggtccgtccgtatttctgtttcccccgaagcct
aaagatactcttatgatctcgcgaacgccggaagtaacttgtgtcgtggtagatgtctcacacgaagatcccgaagtgaaattcaattggtatgtcga
cggcgtggaggtacataacgccaagacgaagcctagagaggaacagtaccagtcaacgtatcgggtcgtatccgtgctcaccgtgctccaccaggatt
ggctgaacggaaaggagtacaagtgcaaagtctcgaacaaggcgttgcctgcgccaatcgaaaagacgatctccaaagctaagggacaaccaagggaa
ccacaagtgtatactctcccgccctcgcgcgaagagatgacaaagaatcaggtgtcactttggtgcttggtgaaggggttctatccctcggatattgc
ggtcgagtgggagagcaatggtcaaccggagaacaattacaagacgacaccgcccgtattggactccgacgggtccttctttctctactcgaagctca
ctgtagataagtcgcgatggcagcaggggaacgtctttagctgttccgtgatgcacgaggcacttcataaccactatacccagaagtcgttgtcgctt
tcccccggaaaa SEQ ID NO:180 (encodes SEQ ID NO:181):
gaaccgaaatcatgcgataaaacacacacatgcccaccatgcccagcgcctgaacttttgggaggtccctcggtgtttttgtttcctcctaagcctaa
ggacaccctgatgatctcccgcactccggaagtgacgtgtgtcgtagtcgacgtcagccatgaggaccctgaggtgaaattcaactggtacgtagatg
gtgtggaggtgcataatgcaaaaactaagcctcgggaggaacaatatcaaagcacataccgggtcgtgtccgtgctcacggtacttcatcaggattgg
ctcaacgggaaagaatacaaatgtaaggtgtccaacaaggctctcccggcaccgattgagaaaacgatcagcaaggccaaggggcagccccgagaacc
ccaagtatacacacttcccccgtccagggaggagatgaccaagaaccaggtgtcgctgtcgtgtgcggtcaaggggttttatcccagcgacatcgcgg
tagagtgggagtcgaacggccagcccgagaacaactacaagacaacaccgcctgtattggactcggacgggtcgtttttcctggtcagcaagctcaca
gtggataaaagccgctggcagcaggggaatgtattctcctgctccgtcatgcacgaggcgcttcacaaccattacacgcaaaaatccctgtccttgtc
caagtcatgcgacaagacgggaggaggagggtcaggcggaggaggaagcgggggtggagggtccggtggtggtgggagcggaggtggagggagcggtg
gaggtggtagcgggggaggtggatcgggagggggtgggagctgtccgccatgtccagccccggaacttctcgggggaccgtcagtctttctttttccg
ccgaagcccaaggacaccttgatgattagccgcacgccggaggtcacgtgcgtagtagtggatgtatcccacgaggaccccgaggtcaaattcaattg
gtatgtcgacggagtggaagtacacaacgcaaagacaaagccgagagaagagcagtaccaatccacttatagggtagtctcggtcttgacagtactgc
accaggactggcttaatggaaaggaatacaagtgcaaagtctcaaacaaagccctccccgcacccatcgaaaagacaatctcgaaagcgaaaggacag
cccagagagcctcaagtgtataccctgcccccgtcaagagaagagatgacgaagaaccaagtgtccctctggtgtctcgtgaaaggtttttaccccag
cgatattgccgtcgaatgggaaagcaatggtcagcccgaaaacaattacaagactacgcctcccgtattggattcggatggttcgttcttcttgtact
caaagcttactgtcgataagtcgcggtggcagcaaggcaatgtgtttagctgttcggtaatgcatgaggcgctccacaatcactatacacagaagagc
ttgtccctcagcggggagtgc

*Fig. 10*
(Cont'd)

SEQ ID NO:182 (encodes SEQ ID NO:183):
gaaccgaaatcatgcgacaagacccacacctgcccaccgtgtccagcgcccgagctcctcggagggccgtcggtgttcctcttccccccaaagcctaa
agacactctgatgatcagccgcactccagaagtgacatgtgtggtggtggatgtctcgcatgaggacccggaagtcaaattcaattggtacgtggatg
gtgtcgaagtgcacaacgccaagacaaaaccgcgcgaggagcagtaccagagcacctaccgggtggtatcagtgcttacagtactgcatcaggattgg
ctgaacggaaaggagtacaagtgtaaagtcagcaacaaagcgctcccggctccgatcgagaaaacgatctcaaaggccaagggccagccgcgagaacc
ccaagtatacacgttgccccttcaagggaggaaatgaccaagaatcaggtgtcactgagctgcgccgtcaagggattctacccctcggacattgcag
tagagtgggagtcgaatgggcaacccgaaaacaactataagacgacacccccggtcctcgactcagatggatcgttcttccttgtatcaaaattgacg
gtcgacaagagccggtggcagcaaggtaacgtattttcgtgttcggtgatgcatgaagcgctgcataaccactatacgcagaagagcttgtccttgtc
accaggcaagggaggtgggggttcgggcggaggaggtagcggcggaggggggtagcggaggtggcgggtcctgtcccccgtgccccgcaccggagctgc
tgggaggtccgtcagtgtttttgtttcctcccaagccgaaagacacgctgatgatctcgaggacgcccgaggtaacgtgcgtcgtcgtcgatgtatcc
cacgaagatcccgaggtcaagttcaactggtatgtagatggggtcgaagtccataacgctaagacaaagccgagagaggaacaatatcagtcaactta
tcgggtcgtgtcggtcctgaccgtacttcaccaggactggctcaatgggaaagagtacaaatgcaaggtgtccaataaggcgctgcctgcgccaattg
agaaaactatctcgaaagcgaagggacagcccagagagccgcaagtatatacactgccaccctcgagagaagaaatgacgaagaatcaagtctccttg
tggtgtttggtgaaggggttttacccttcagacatcgcagtggaatgggaatcgaacgggcagccagaaaacaattacaaaaccacacctcctgtcct
tgactccgatggctcatttttcctctattcgaagctcactgtcgacaagtcgcgctggcagcagggtaacgtctttagctgctccgtgatgcacgagg
ccctccacaatcattatacacagaaatcgctgtcactttcgcccggaaaa SEQ ID NO:184 (encodes SEQ ID NO:185):
gaaccgaaatcatgcgacaaaacgcacacctgtccgccctgtcctgccccggaacttctcggagggccttccgtgtttctcttccctccgaagcccaa
ggacacgctgatgatctcccggaccccggaggtcacgtgtgtggtagtagacgtgtcacacgaagatccggaggtgaagttcaactggtacgtagatg
gcgtggaggtgcacaacgccaaaacgaagccccgagaggaacagtaccagtcaacgtaccgcgtcgtgtcggtattgactgtattgcatcaagactgg
ttgaacgggaaggagtataagtgtaaagtcagcaacaaggctcttcccgcacccattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgag
caaatcatgcgacaagaccggggggtggtgggagcggcggaggaggtagcggcggaggtggctcgggaggaggtgggtcgggtggtgggggaagcggag
gcggagggagcggaggtggtgggtcatgtccgccgtgcccggcacccgaactgctcggaggtccctcggtgttcctgttcccgccaaagcctaaggat
acgttgatgatttcgcgcacgccggaggtaacatgcgtggtggtggatgtgtcacatgaggaccccgaggtcaagttcaattggtacgtcgatggagt
ggaagtgcacaatgcgaaaacaaaaccccgggaggagcagtatcagagcacgtacagggtagtctccgtcctgactgtacttcaccaagactggctta
acggaaaagagtataagtgcaaggtcagcaacaaggcgcttcctgcccctatcgagaaaaccatctcgaaggccaagggacagccgagggagcctcaa
gtatacacgctgccgccatcgagagaagaaatgaccaaaaaccaggtgtccctttggtgtttggtgaagggtttctatccctccgatatcgccgtaga
gtgggagtcaaatggacagcctgagaacaactataagactacgccccctgtgttggacagcgatgggtcattctttctgtattcgaaactcacggtgg
ataagtcgcgatggcaacagggcaatgtgttttcgtgcagcgtgatgcatgaggcgctgcacaaccactatactcagaaatcgttaagcttatcggga
gagtgt

*Fig. 10*
(Cont'd)

SEQ ID NO:186 (encodes SEQ ID NO:187):
gaaccgaaatcatgcgacaaaacgcacacctgtccgccctgtcctgccccggaacttctcggagggccttccgtgtttctcttccctccgaagcccaa
ggacacgctgatgatctcccggaccccggaggtcacgtgtgtggtagtagacgtgtcacacgaagatccggaggtgaagttcaactggtacgtagatg
gcgtggaggtgcacaacgccaaaacgaagccccgagaggaacagtaccagtcaacgtaccgcgtcgtgtcggtattgactgtattgcatcaagactgg
ttgaacgggaaggagtataagtgtaaagtcagcaacaaggctcttcccgcacccattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgag
cggggaatgcggaggggggagggtccgggggtggtgggagcggcggaggaggtagcggcggaggtggctcgggaggaggtgggtcgggtggtgggggaa
gcggaggcggagggtcatgtccgccgtgcccggcacccgaactgctcggaggtccctcggtgttcctgttcccgccaaagcctaaggatacgttgatg
atttcgcgcacgccggaggtaacatgcgtggtggtggatgtgtcacatgaggaccccgaggtcaagttcaattggtacgtcgatggagtggaagtgca
caatgcgaaaacaaaaccccgggaggagcagtatcagagcacgtacagggtagtctccgtcctgactgtacttcaccaagactggcttaacggaaaag
agtataagtgcaaggtcagcaacaaggcgcttcctgcccctatcgagaaaaccatctcgaaggccaagggacagccgagggagcctcaagtatacacg
ctgccgccatcgagagaagaaatgaccaaaaaccaggtgtccctttggtgtttggtgaagggtttctatccctccgatatcgccgtagagtgggagtc
aaatggacagcctgagaacaactataagactacgccccctgtgttggacagcgatgggtcattctttctgtattcgaaactcacggtggataagtcgc
gatggcaacagggcaatgtgttttcgtgcagcgtgatgcatgaggcgctgcacaaccactatactcagaaatcgttaagcttatcgaagtcatgcgac
aagact SEQ ID NO:188 (encodes SEQ ID NO:189):
gaaccgaaatcatgcgacaaaacgcacacctgtccgccctgtcctgccccggaacttctcggagggccttccgtgtttctcttccctccgaagcccaa
ggacacgctgatgatctcccggaccccggaggtcacgtgtgtggtagtagacgtgtcacacgaagatccggaggtgaagttcaactggtacgtagatg
gcgtggaggtgcacaacgccaaaacgaagccccgagaggaacagtaccagtcaacgtaccgcgtcgtgtcggtattgactgtattgcatcaagactgg
ttgaacgggaaggagtataagtgtaaagtcagcaacaaggctcttcccgcacccattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgag
caaatcatgcgacaagaccggggtggtgggagcggcggaggaggtagcggcggaggtggctcgggaggaggtgggtcgggtggtgggggaagcggag
gcggagggtcatgtccgccgtgcccggcacccgaactgctcggaggtccctcggtgttcctgttcccgccaaagcctaaggatacgttgatgatttcg
cgcacgccggaggtaacatgcgtggtggtggatgtgtcacatgaggaccccgaggtcaagttcaattggtacgtcgatggagtggaagtgcacaatgc
gaaaacaaaaccccgggaggagcagtatcagagcacgtacagggtagtctccgtcctgactgtacttcaccaagactggcttaacggaaaagagtata
agtgcaaggtcagcaacaaggcgcttcctgcccctatcgagaaaaccatctcgaaggccaagggacagccgagggagcctcaagtatacacgctgccg
ccatcgagagaagaaatgaccaaaaaccaggtgtccctttggtgtttggtgaagggtttctatccctccgatatcgccgtagagtgggagtcaaatgg
acagcctgagaacaactataagactacgccccctgtgttggacagcgatgggtcattctttctgtattcgaaactcacggtggataagtcgcgatggc
aacagggcaatgtgttttcgtgcagcgtgatgcatgaggcgctgcacaaccactatactcagaaatcgttaagcttatcgggagagtgt

*Fig. 10*
(Cont'd)

SEQ ID NO:190 (encodes SEQ ID NO:191):
gaaccgaaatcatgcgacaaaacgcacacctgtccgccctgtcctgccccggaacttctcggagggccttccgtgtttctcttccctccgaagcccaa
ggacacgctgatgatctcccggaccccggaggtcacgtgtgtggtagtagacgtgtcacacgaagatccggaggtgaagttcaactggtacgtagatg
gcgtggaggtgcacaacgccaaaacgaagccccgagaggaacagtaccagtcaacgtaccgcgtcgtgtcggtattgactgtattgcatcaagactgg
ttgaacgggaaggagtataagtgtaaagtcagcaacaaggctcttcccgcacccattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgag
caaatcatgcgacaagaccggggtggtgggagcggcggaggaggtagcggcggaggtggctcgggaggaggtgggtcgggtggtgggggatcatgtc
cgccgtgcccggcacccgaactgctcggaggtccctcggtgttcctgttcccgccaaagcctaaggatacgttgatgatttcgcgcacgccggaggta
acatgcgtggtggtggatgtgtcacatgaggaccccgaggtcaagttcaattggtacgtcgatggagtggaagtgcacaatgcgaaaacaaaaccccg
ggaggagcagtatcagagcacgtacagggtagtctccgtcctgactgtacttcaccaagactggcttaacggaaaagagtataagtgcaaggtcagca
acaaggcgcttcctgcccctatcgagaaaaccatctcgaaggccaagggacagccgagggagcctcaagtatacacgctgccgccatcgagagaagaa
atgaccaaaaaccaggtgtccctttggtgtttggtgaagggtttctatccctccgatatcgccgtagagtgggagtcaaatggacagcctgagaacaa
ctataagactacgccccctgtgttggacagcgatgggtcattctttctgtattcgaaactcacggtggataagtcgcgatggcaacagggcaatgtgt
tttcgtgcagcgtgatgcatgaggcgctgcacaaccactatactcagaaatcgttaagcttatcgggagagtgt SEQ ID NO:192 (encodes SEQ ID NO:193):
gaaccgaaatcatgcgacaaaacgcacacttgtccgccctgccctgcgcccgaactgcttggaggcccttcggtgtttttgtttccgcccaagcctaa
ggacaccttgatgatcagccggacaccggaggtcacatgtgtcgtcgtggatgtctcgcacgaggatcccgaggtcaagtttaactggtatgtggatg
gagtggaggtccacaacgccaaaaccaagcccagggaggagcaataccagtcaacctatcgggtagtctcggtgctgacggtactgcaccaggactgg
ttgaatggaaaagagtacaaatgcaaggtatcaaacaaggcccttcccgctcccatcgaaaagacgatcagcaaagcgaaagggcaacccagagagcc
ccaagtctatacgctgcctccctcaagggaagaaatgacgaaaaaccaggtgcacttgacatgcctcgtgaaaggcttctacccgagcgacattgcgg
tggaatgggagtcaaatggtcagccggaaaacaactacaagacaactccaccggtccttgattcagacgggtcgttcgccctctatagcaaactcacg
gtcgacaagtcccgctggcagcagggtaacgtgttttcgtgttcagtgatgcacgaggctctgcataatcactacacacagaagtccctctccttgag
caaaagctgcgacaagacaggggtggaggttcaggcggtggtgggtcgggagggggagggtcaggtggaggcggcagcggggtgggggatcgggag
gaggagggtccgggggagggggttccggagggggtgggtcctgtccccccttgtccagcgccggagctgttgggcggaccttcggtattcttgtttcct
cctaagcccaaagatacgcttatgatctcccgcaccccggaggtaacttgcgtcgtagtggatgtatcacatgaggacccagaagtcaagttcaattg
gtacgtggacggagtcgaagtccataacgctaaaacgaaaccgagagaggaacagtatcagagcacctaccgggtagtgagcgtgctcacagtgttgc
atcaggattggctgaatgggaaggaatacaagtgcaaagtgtcgaataaggcattgccagcaccgattgagaaaacaatctcaaaagcgaagggacag
ccccgagagcctcaagtcactacactgccacccagccgcgaagagatgacaaagaatcaggtatccctcacgtgtcttgtgaaggggttctatccctc
cgatatcgcagtagagtgggaatcgaacgggcagccggagaacaattacaagactttcccgccagtgcttgattcggacggtagcttctttttgtatt
cgaagctcacggtagataagtcgaggtggcaacaaggaaatgtgttttcatgttcggtgatgcatgaagcgctccataaccactatacgcagaaatcg
ctttcgctctccggtgaatgc

*Fig. 10*
(Cont'd)

SEQ ID NO:194 (encodes SEQ ID NO:195):
gaaccgaaatcatgcgacaaaacgcacacttgtccgccgtgcccagcgcccgagttgcttggcggacccagcgtgtttttgtttcccccgaaaccgaa
agatacattgatgattagcagaacgcccgaagtgacgtgtgtagtagtcgacgtgtcgcacgaagatccggaggtgaagttcaactggtatgtcgatg
gggtagaggtgcacaacgcgaaaaccaagcccagggaggagcagtaccagtcgacatatcgggtcgtgtcagtgctgacagtgctccatcaggactgg
ttgaacgggaaggagtataagtgtaaagtcagcaacaaagccctccccgcacccatcgagaaaaccatttccaaggcaaagggacaaccgagggaacc
acaagtctacactctcccaccctcccgcgaagaaatgacgaaaaaccaagtgtcactgacgtgtcttgtagatggtttctacccctcggacatcgcgg
tcgaatgggagtcgaatggacagccggagaacaattacgataccacacctcctgtcttggattcggacggctcattcttcctttacagcgatctcact
gtcgacaagtcgcgctggcagcagggaaacgtcttttcctgttcggtaatgcacgaagctctgcacaatcactacacgcagaagtcgctttcactttc
caaaagctgcgacaagacaggggtggaggttcaggcggtggtgggtcgggaggggagggtcaggtggaggcggcagcggggtgggggatcgggag
gaggagggtccgggggagggggttccggagggggtgggtcctgtccccttgtccagcgccggagctgttgggcggaccttcggtattcttgtttcct
cctaagcccaaagatacgcttatgatctcccgcaccccggaggtaacttgcgtcgtagtggatgtatcacatgaggacccagaagtcaagttcaattg
gtacgtggacggagtcgaagtccataacgctaaaacgaaaccgagagaggaacagtatcagagcacctaccgggtagtgagcgtgctcacagtgttgc
atcaggattggctgaatgggaaggaatacaagtgcaaagtgtcgaataaggcattgccagcaccgattgagaaaacaatctcaaaagcgaagggacag
ccccgagagcctcaagtctatacactgccgccaagccggaagaagatgaccaaaaaccaggtgtccctcacgtgcctcgtgaaagggttttacccgtc
agatatcgccgtagaatgggagagcaatgggcagcccgagaataactataagactacgccccctgtactcaaatcggacgggtcattctttctgtatt
cgaagctcacggtagataagtcgaggtggcaacaaggaaatgtgttttcatgttcggtgatgcatgaagcgctccataaccactatacgcagaaatcg
ctttcgctctccggtgaatgc <u>Nucleotide sequences encoding the polypeptides of Figure 7:</u>

SEQ ID NO:196 (encodes SEQ ID NO:197):
gaaccgaaatcatgcgacaagacccatacatgcccaagctgtcccgctccggagtttctcggtggaccgtcggtgtttctgttccctccgaagccaaa
agataccttgatgatttcgcgaactcccgaagtcacgtgtgtcgtcgtggacgtaagccaggaggacccggaggtccagttcaattggtatgtagacg
gcgtagaggtacataatgcgaaaacgaagcccagagaggaacagttcaatagcaaataccgcgtagtatcggtgctgacagtgttgcaccaggactgg
ctgaatggaaaagaatacaagtgtaaagtgtccaacaagggccttccatcgtcgattgaaaagacaatctccaaggcaaaggggcagcctagggagcc
ccaagtctacaccctgcccccttcgcgggaggagatgacgaagaaccaggtatcactgtcatgcgcggtcaaaggattttacccgagcgacatcgccg
tagaatgggagtccaacggacagccagaaaacaattacaagaccactcctccagtgctcgatagcgatggctccttctttcttgtcagcaaattgaca
gtcgataagtcaagatggcagcagggtaatgtgttctcatgtagcgtcatgcacgaagcactccacaatcattatacacagaagagcctctcgttgtc
gcccggaaaaggcggaggtgggtcgggcggaggggaagcggtggaggagggtcaggaggtggaggttccgggggaggcggttcgggaggaggggggtt
cgggtggtggaggatcgggtggcggaggaagctgcccttcatgtccagcccccgagttcctcggaggcccgtcggtctttctttttcccctaagcct
aaagataccctgatgatcagccggacgcctgaggtgacttgtgtggtagtcgacgtgtcccaagaagatccggaagtccagtttaactggtatgtgga
tggagtggaggtccataatgccaagacaaagccaagggaggagcaattcaactcgaagtaccgcgtcgtgtccgtgctcacagtgcttcatcaagact
ggttgaacggaaaggagtacaaatgtaaggtatcaaacaagggtttgccctcgtccatcgagaaaaccatctcgaaagcgaaagggcaaccccgcgag
ccccaggtatatacgctcccgccttcaagagaagaaatgacgaaaaaccaagtgagcttgtggtgcctggtcaaggggttctatccctccgatatcgc
ggtagagtgggaaagcaatgggcagccggagaacaactataagacaacgcctcccgtgttggactcagatggatcgttcttcttgtactcaaagctta

Fig. 10
(Cont'd)

SEQ ID NO:198 (encodes SEQ ID NO:199):
gaaccgaaatcatgcgataagacacacacgtgcccctcgtgccccgcaccggagttccttggggtccgtcggtctttttgtttccccctaaacccaa
ggacacgctcatgatctcccgcacaccggaagtcacgtgcgtagtcgtggatgtctcacaagaggacccggaagtgcaattcaactggtacgtcgacg
gcgtggaggtgcacaatgccaagacgaaaccaagagaggaacagttcaactcaaagtaccgggtagtatcggtgttgacggtgctccatcaggattgg
cttaacggtaaagagtacaagtgtaaagtcagcaataagggtctgcccagctccatcgaaaagactatctccaaggccaaggggcagcctcgcgaacc
gcaagtgtgtacgttgcccccgtcccgggaggagatgacgaaaaatcaggtcagcctctcgtgtgcggtgaaggggttttacccatccgacattgcgg
tggaatgggagagcaacggacagcccgaaaacaattacaagactaccccgccagtactcgatagcgacgggtcgttctttcttgtgtcgaaactgaca
gtggacaagtcaagatggcagcaaggaaatgtgttctcgtgtagcgtgatgcacgaggcactccacaatcattacacacagaagagcttgtccctctc
ccctggtaaaggaggaggagggtcgggtgggggaggcagcgggggaggaggatcaggaggtgggggttcaggcggaggggttcgggtggtgggggat
cgggaggtggaggttcgggaggaggggctcctgtccgagctgccccgctcccgagttcttgggaggtccctcagtgtttcttttcccgccgaagcct
aaagatacactgatgatttcacgaacccccgaagtgacatgcgtagtagtagatgtgtcgcaagaagatccggaagtccagttcaattggtatgtgga
tggggtggaggtccataatgcgaaaacaaaaccgcgggaagagcaattcaattcaaagtatagggtcgtcagcgtgctcacagtgctgcaccaggact
ggcttaatgggaaagaatacaagtgcaaggtatccaacaaggggttgccctcgtcgatcgagaaaacgatttcaaaagccaagggacaaccgagggaa
ccacaagtatgcacgctgccgccgtgtagggaagaaatgacgaagaaccaagtgagcctctggtgcctggtgaagggctttatccctccgacatcgc
agtcgagtgggaatcgaatgggcagccggagaacaactataagactactcccccagtgttggattcggatggatcatttttcctctactcgaaactta
cggtcgacaaatcacgctggcagcagggcaacgtgttttcctgctcggtaatgcatgaggcgcttcacaaccactatacccagaagtcactgtcgctt
agcccagggaaa SEQ ID NO:200 (encodes SEQ ID NO:201):
gaaccgaaatcatgcgacaagacccatacgtgcccatcgtgccccgcaccggagttcctcggaggcccgtcagtattcctttttcctccgaagcccaa
agatacattgatgatcagcaggacgcctgaagtgacatgtgtagtggtagacgtgtcgcaagaagatccagaggtacagtttaactggtatgtcgacg
gggtggaagtccataacgccaagactaaaccccgcgaagagcagttcaactcaaagtatagagtagtctccgtcctgacagtcctccatcaggactgg
ctgaacgggaaagaatacaagtgcaaagtctcgaacaaagggcttccgtcatcgatcgagaaaacgatttcaaaagccaagggacagcctagggagcc
gcaagtgtatactctgcccccgtcgcgcgaggagatgacgaaaaatcaggtgtccctcacgtgcctcgtcaaaggattttacccgtcggatatcgccg
tggagtgggaatcgaatgggcaaccagagaacaactacaagaccactcccccggtgctggactcggacggctcctttttcttgacatcaaagctcaca
gtcgataagagccgctggcaacaagggaatgtgttcagctgctcggtgatgcacgaagcgctgcacaaccactatacccagaaatcattgtccctcag
ccccggaaagggaggtggagggtccggtgggggtggatcaggagggggtgggagcggaggaggcggcagcggtggcggagggtcaggtggaggcggat
caggtgggggaggttcaggcggtgggggctcgtgccccagctgtcctgctcccgagtttctcggggggaccttcagtctttctcttccctccgaaaccc
aaggacacgctgatgatttcgcggacacccgaagtgacttgtgtcgtggtcgacgtaagccaggaggaccccgaggtgcaattcaactggtacgtcga
cggagtcgaggtccacaatgcgaaaacaaaacccagagaagaacagttcaattcgaaatatcgagtggtatcagtcctgaccgtgcttcatcaggatt
ggctcaatgggaaagagtacaaatgcaaggtatcaaacaagggactgccaagctcaatcgaaaagactatctcgaaagcaaagggtcagcctcgggag
ccccaagtgtacacgcttcccccatccagggaagaaatgacgaagaaccaggtgtcgctctactgtttggtgaaggggttttatccttcggacatcgc
ggtggaatgggagtcgaatggacagccggagaataactacaaaacgactccgcctgtcctcgacagcgatgggtccttcttcctttactcaaaattga
cagtagataagtcgcgctggcagcagggaaatgtattctcctgttccgtcatgcatgaggcgcttcacaatcactacactcagaagtccttgtcgttg
tcaccaggaaaa

*Fig. 10*
(Cont'd)

SEQ ID NO:202 (encodes SEQ ID NO:203):
gaaccgaaatcatgcgacaagacatgctgttgcccaagctgtcccgctccggagtttctcggtggaccgtcggtgtttctgttccctccgaagccaaa
agataccttgatgatttcgcgaactcccgaagtcacgtgtgtcgtcgtggacgtaagccaggaggacccggaggtccagttcaattggtatgtagacg
gcgtagaggtacataatgcgaaaacgaagcccagagaggaacagttcaatagcaaataccgcgtagtatcggtgctgacagtgttgcaccaggactgg
ctgaatggaaaagaatacaagtgtaaagtgtccaacaagggccttccatcgtcgattgaaaagacaatctccaaggcaaaggggcagcctagggagcc
ccaagtctacaccctgcccccttcgcgggaggagatgacgaagaaccaggtatcactgtcatgcgcggtcaaaggatttacccgagcgacatcgccg
tagaatgggagtccaacggacagccagaaaacaattacaagaccactcctccagtgctcgatagcgatggctccttctttcttgtcagcaaattgaca
gtcgataagtcaagatggcagcagggtaatgtgttctcatgtagcgtcatgcacgaagcactccacaatcattatacacagaagagcctctcgttgtc
gcccggaaaaggcggaggtgggtcgggcggaggggaagcggtggaggagggtcaggaggtggaggttccgggggaggcggttcgggaggaggggtt
cgggtggtggaggatcgggtggcggaggaagctgcccttcatgtccagcccccgagttcctcggaggcccgtcggtctttctttttcccctaagcct
aaagataccctgatgatcagccggacgcctgaggtgacttgtgtggtagtcgacgtgtcccaagaagatccggaagtccagtttaactggtatgtgga
tggagtggaggtccataatgccaagacaaagccaagggaggagcaattcaactcgaagtaccgcgtcgtgtccgtgctcacagtgcttcatcaagact
ggttgaacggaaaggagtacaaatgtaaggtatcaaacaagggtttgccctcgtccatcgagaaaaccatctcgaaagcgaaagggcaaccccgcgag
ccccaggtatatacgctcccgccttcaagagaagaaatgactaaaaccaagtgagcttgtggtgcctggtcaaggggttctatccctccgatatcgc
ggtagagtgggaaagcaatgggcagccggagaacaactataagacaacgcctcccgtgttggactcagatggatcgttcttcttgtactcaaagctta
cggtggacaagtcacgctggcagcaagggaacgtgttttcgtgctcggtgatgcacgaggcgcttcacaatcactacactcagaaatcgcttagcttg
tcaccaggaaaa SEQ ID NO:204 (encodes SEQ ID NO:205):
gaaccgaaatcatgcgacaagtgccatacatgcccaagctgtcccgctccggagtttctcggtggaccgtcggtgtttctgttccctccgaagccaaa
agataccttgatgatttcgcgaactcccgaagtcacgtgtgtcgtcgtggacgtaagccaggaggacccggaggtccagttcaattggtatgtagacg
gcgtagaggtacataatgcgaaaacgaagcccagagaggaacagttcaatagcaaataccgcgtagtatcggtgctgacagtgttgcaccaggactgg
ctgaatggaaaagaatacaagtgtaaagtgtccaacaagggccttccatcgtcgattgaaaagacaatctccaaggcaaaggggcagcctagggagcc
ccaagtctacaccctgcccccttcgcgggaggagatgacgaagaaccaggtatcactgtcatgcgcggtcaaaggatttacccgagcgacatcgccg
tagaatgggagtccaacggacagccagaaaacaattacaagaccactcctccagtgctcgatagcgatggctccttctttcttgtcagcaaattgaca
gtcgataagtcaagatggcagcagggtaatgtgttctcatgtagcgtcatgcacgaagcactccacaatcattatacacagaagagcctctcgttgtc
gcccggaaaaggcggaggtgggtcgggcggaggggaagcggtggaggagggtcaggaggtggaggttccgggggaggcggttcgggaggaggggtt
cgggtggtggaggatcgggtggcggaggaagctgcccttcatgtccagcccccgagttcctcggaggcccgtcggtctttctttttcccctaagcct
aaagataccctgatgatcagccggacgcctgaggtgacttgtgtggtagtcgacgtgtcccaagaagatccggaagtccagtttaactggtatgtgga
tggagtggaggtccataatgccaagacaaagccaagggaggagcaattcaactcgaagtaccgcgtcgtgtccgtgctcacagtgcttcatcaagact
ggttgaacggaaaggagtacaaatgtaaggtatcaaacaagggtttgccctcgtccatcgagaaaaccatctcgaaagcgaaagggcaaccccgcgag
ccccaggtatatacgctcccgccttcaagagaagaaatgacgaaaaaccaagtgagcttgtggtgcctggtcaaggggttctatccctccgatatcgc
ggtagagtgggaaagcaatgggcagccggagaacaactataagacaacgcctcccgtgttggactcagatggatcgttcttcttgtactcaaagctta
cggtggacaagtcacgctggcagcaagggaacgtgttttcgtgctcggtgatgcacgaggcgcttcacaatcactacactcagaaatcgcttagcttg
tcaccaggaaaa

*Fig. 10*
(Cont'd)

SEQ ID NO:206 (encodes SEQ ID NO:207):
gaaccgaaatcatgcgataaaacgcacacgtgcccctcgtgtccggcaccggagtttcttggaggtccctcggtgttcctgttccctcccaagccgaa
ggacacgttgatgatttcgaggacgccggaggtgacgtgtgtggtcgtagacgtgagccaggaggacccggaagtgcagtttaactggtacgtcgatg
gagtagaagtacataatgccaagacgaagcccagggaggaacaattcaattcgaagtatcgcgtcgtatccgtgctgactgtgctccaccaggactgg
cttaacggaaaagaatacaagtgcaaggtatcaaataagggactcccctcgtcgatcgagaaaacaatcagcaaagcgaaaggacagccgagggaacc
gcaagtgtacacattgccgccgtcgcgagaagaaatgaccaagaaccaggtatcactctcgtgcgccgtgaagggctttacccatcggacattgctg
tggagtgggagagcaacggtcaacccgagaataactacaaaactacaccgcccgtgctggattccgacggctcattctttctcgtgtcaaaactgact
gtggataagtcgcgctggcaacaggggaatgtgttctcgtgcagcgtcatgcatgaagctcttcataatcactacacccaaaaatccctgtcactctc
gaaaagctgtgataagaccggggtgggggctccggaggaggcggttcgggtggcggtgggtcgggtggaggcggatcgggcggtgggggaagcggtg
gtggtggaagcggaggggggtggatcaggtggagggggcagctgtccatcctgccctgcaccagagtttttgggaggaccgtccgtatttctgtttccg
cccaagcccaaagatactttgatgatcagcaggacgcctgaggtaacatgtgtagtggtcgatgtctcgcaagaggaccctgaggtccagttcaattg
gtacgtggacggggtggaagtccacaacgcgaaaacgaaaccacgcgaagaacagttcaacagcaaatacagagtcgtgtcagtcttgacagtccttc
accaggattggttgaatggaaaggagtacaagtgtaaggtgtcaaacaaaggactgcccagctcgatcgaaaagacaatttcgaaggcaaaggtcaa
ccgcgggagccacaagtgtatacgctgccgccctcgcgggaggagatgacaaagaatcaggtgtcgctgtggtgtctggtaaaggattctatccatc
cgatatcgcggtagagtgggaatcaaacggccagccggagaacaattacaagaccacgccccctgtattggattcggacggatcgttcttcttgtatt
cgaaactcacggtggacaagtcgcggtggcagcagggtaatgtgttttcatgctcagtcatgcacgaggcgctccataaccattatactcagaagtcg
ctgtccttgtccggggagtgc SEQ ID NO:208 (encodes SEQ ID NO:209):
gaaccgaaatcatgcgacaagacccatacatgcccaagctgtcccgctccggagtttctcggtggaccgtcggtgtttctgttccctccgaagccaaa
agataccttgatgatttcgcgaactcccgaagtcacgtgtgtcgtcgtggacgtaagccaggaggacccggaggtccagttcaattggtatgtagacg
gcgtagaggtacataatgcgaaaacgaagcccagagaggaacagttcaatagcaaataccgcgtagtatcggtgctgacagtgttgcaccaggactgg
ctgaatggaaaagaatacaagtgtaaagtgtccaacaagggccttccatcgtcgattgaaaagacaatctccaaggcaaaggggcagcctagggagcc
ccaagtctacaccctgccccctcgcgggaggagatgacgaagaaccaggtatcactgtcatgcgcggtcaaaggatttacccgagcgacatcgccg
tagaatgggagtccaacggacagccagaaaacaattacaagaccactcctccagtgctcgatagcgatggctccttctttcttgtcagcaaattgaca
gtcgataagtcaagatggcagcagggtaatgtgttctcatgtagcgtcatgcacgaagcactccacaatcattatacacagaagagcctctcgttgtc
gcccggaaaaggcggaggtgggtcgggcggaggggggaagcggtggaggagggtcaggaggtggaggttcctgcccttcatgtccagcccccgagttcc
tcggaggcccgtcggtctttctttttccccctaagcctaaagataccctgatgatcagccggacgcctgaggtgacttgtgtggtagtcgacgtgtcc
caagaagatccggaagtccagtttaactggtatgtggatggagtggaggtccataatgccaagacaaagccaagggaggagcaattcaactcgaagta
ccgcgtcgtgtccgtgctcacagtgcttcatcaagactggttgaacggaaaggagtacaaatgtaaggtatcaacaagggtttgccctcgtccatcg
agaaaaccatctcgaaagcgaaagggcaaccccgcgagccccaggtatatacgctcccgccttcaagagaagaaatgacgaaaaaccaagtgagcttg
tggtgcctggtcaaggggttctatccctccgatatcgcggtagagtgggaaagcaatgggcagccggagaacaactataagacaacgcctcccgtgtt
ggactcagatggatcgttcttcttgtactcaaagcttacggtggacaagtcacgctggcagcaagggaacgtgttttcgtgctcggtgatgcacgagg
cgcttcacaatcactacactcagaaatcgcttagcttgtcaccaggaaaa Fig. 10
(Cont'd)

SEQ ID NO:210 (encodes SEQ ID NO:211):
gaaccgaaatcatgcgacaaaacgcacacctgtccgtcatgtcctgccccggaattccttggagggccttccgtgtttctcttccctccgaagcccaa
ggacacgctgatgatctcccggaccccggaggtcacgtgtgtggtagtagacgtgtcacaagaagatccggaggtgcagttcaactggtacgtagatg
gcgtggaggtgcacaacgccaaaacgaagccccgagaggaacagttcaattcgaagtaccgcgtcgtgtcggtattgactgtattgcatcaagactgg
ttgaacgggaaggagtataagtgtaaagtcagcaacaagggacttccctcgtcaattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgtc
gaaaagctgcgacaagacgggaggggagggtccgggggtggtgggagcggcggaggaggtagcggcggaggtggctcgggaggaggtgggtcgggtg
gtgggggaagcggaggcggagggtcatgtccgagctgcccggcacccgaatttctcggaggtccctcggtgttcctgttcccgccaaagcctaaggat
acgttgatgatttcgcgcacgccggaggtaacatgcgtggtggtggatgtgtcacaagaggaccccgaggtccagttcaattggtacgtcgatggagt
ggaagtgcacaatgcgaaaacaaaaccccgggaggagcagttcaatagcaagtacagggtagtctccgtcctgactgtacttcaccaagactggctta
acggaaaagagtataagtgcaaggtcagcaacaaggggcttccttcatccatcgagaaaaccatctcgaaggccaagggacagccgagggagcctcaa
gtatacacgctgccgccatcgagagaagaaatgaccaaaaaccaggtgtccctttggtgtttggtgaagggtttctatccctccgatatcgccgtaga
gtgggagtcaaatggacagcctgagaacaactataagactacgccccctgtgttggacagcgatgggtcattctttctgtattcgaaactcacggtgg
ataagtcgcgatggcaacagggcaatgtgttttcgtgcagcgtgatgcatgaggcgctgcacaaccactatactcagaaatcgttaagcttatcggga
gagtgt SEQ ID NO:212 (encodes SEQ ID NO:213):
gaaccgaaatcatgcgacaaaacgcacacctgtccgtcatgtcctgccccggaattccttggagggccttccgtgtttctcttccctccgaagcccaa
ggacacgctgatgatctcccggaccccggaggtcacgtgtgtggtagtagacgtgtcacaagaagatccggaggtgcagttcaactggtacgtagatg
gcgtggaggtgcacaacgccaaaacgaagccccgagaggaacagttcaattcgaagtaccgcgtcgtgtcggtattgactgtattgcatcaagactgg
ttgaacgggaaggagtataagtgtaaagtcagcaacaagggacttccctcgtcaattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgtc
gggggaatgcggaggggagggtccggaggggagggtccgggggtggtgggagcggcggaggaggtagcggcggaggtggctcgggaggaggtgggc
cgggtggtgggggatcatgtccgagctgcccggcacccgaatttctcggaggtccctcggtgttcctgttcccgccaaagcctaaggatacgttgatg
atttcgcgcacgccggaggtaacatgcgtggtggtggatgtgtcacaagaggaccccgaggtccagttcaattggtacgtcgatggagtggaagtgca
caatgcgaaaacaaaaccccgggaggagcagttcaatagcaagtacagggtagtctccgtcctgactgtacttcaccaagactggcttaacggaaaag
agtataagtgcaaggtcagcaacaaggggcttccttcatccatcgagaaaaccatctcgaaggccaagggacagccgagggagcctcaagtatacacg
ctgccgccatcgagagaagaaatgaccaaaaaccaggtgtccctttggtgtttggtgaagggtttctatccctccgatatcgccgtagagtgggagtc
aaatggacagcctgagaacaactataagactacgccccctgtgttggacagcgatgggtcattctttctgtattcgaaactcacggtggataagtcgc
gatggcaacagggcaatgtgttttcgtgcagcgtgatgcatgaggcgctgcacaaccactatactcagaaatcgttaagcttatcgaagtcatgcgac
aagact

*Fig. 10*
(Cont'd)

SEQ ID NO:214 (encodes SEQ ID NO:215):
gaaccgaaatcatgcgacaaaacgcacacctgtccgtcatgtcctgccccggaattccttggagggccttccgtgtttctcttccctccgaagcccaa
ggacacgctgatgatctcccggaccccggaggtcacgtgtgtggtagtagacgtgtcacaagaagatccggaggtgcagttcaactggtacgtagatg
gcgtggaggtgcacaacgccaaaacgaagccccgagaggaacagttcaattcgaagtaccgcgtcgtgtcggtattgactgtattgcatcaagactgg
ttgaacgggaaggagtataagtgtaaagtcagcaacaagggacttccctcgtcaattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgtc
gaaaagctgcgacaagacgggagggggagggtccgggggtggtgggagcggcggaggaggtagcggcggaggtggctcgggaggaggtgggtcgggtg
gtgggggatcatgtccgagctgcccggcacccgaatttctcggaggtccctcggtgttcctgttcccgccaaagcctaaggatacgttgatgatttcg
cgcacgccggaggtaacatgcgtggtggtggatgtgtcacaagaggaccccgaggtccagttcaattggtacgtcgatggagtggaagtgcacaatgc
gaaaacaaaaccccgggaggagcagttcaatagcaagtacagggtagtctccgtcctgactgtacttcaccaagactggcttaacggaaaagagtata
agtgcaaggtcagcaacaaggggcttccttcatccatcgagaaaaccatctcgaaggccaagggacagccgagggagcctcaagtatacacgctgccg
ccatcgagagaagaaatgaccaaaaaccaggtgtccctttggtgtttggtgaagggtttctatccctccgatatcgccgtagagtgggagtcaaatgg
acagcctgagaacaactataagactacgcccccctgtgttggacagcgatgggtcattctttctgtattcgaaactcacggtggataagtcgcgatggc
aacagggcaatgtgttttcgtgcagcgtgatgcatgaggcgctgcacaaccactatactcagaaatcgttaagcttatcgggagagtgt SEQ ID NO:216 (encodes SEQ ID NO:217):
gaaccgaaatcatgcgacaaaacgcacacctgtccgtcatgtcctgccccggaattccttggagggccttccgtgtttctcttccctccgaagcccaa
ggacacgctgatgatctcccggaccccggaggtcacgtgtgtggtagtagacgtgtcacaagaagatccggaggtgcagttcaactggtacgtagatg
gcgtggaggtgcacaacgccaaaacgaagccccgagaggaacagttcaattcgaagtaccgcgtcgtgtcggtattgactgtattgcatcaagactgg
ttgaacgggaaggagtataagtgtaaagtcagcaacaagggacttccctcgtcaattgaaaagacaatttcgaaagccaaaggccagcccagggagcc
ccaagtgtacaccctgccacccagccgggaagagatgacaaagaatcaagtctcgcttagctgcgctgtcaagggcttctatccatcggacattgcag
tggaatgggaatcaaacggacagccggagaataactataagacgacacccccctgtcctcgacagcgacgggtcgttcttccttgtgagcaagctcacg
gtcgacaaaagccgctggcagcagggaaacgtattctcatgttcggtgatgcacgaagcattgcataaccactacacgcagaagagcttgtcgttgtc
gaaaagctgcgacaagacgggagggggagggtccgggggtggtgggagcggcggaggaggtagcggcggaggtggctcgggaggaggtgggtcatgtc
cgagctgcccggcacccgaatttctcggaggtccctcggtgttcctgttcccgccaaagcctaaggatacgttgatgatttcgcgcacgccggaggta
acatgcgtggtggtggatgtgtcacaagaggaccccgaggtccagttcaattggtacgtcgatggagtggaagtgcacaatgcgaaaacaaaaccccg
ggaggagcagttcaatagcaagtacagggtagtctccgtcctgactgtacttcaccaagactggcttaacggaaaagagtataagtgcaaggtcagca
acaaggggcttccttcatccatcgagaaaaccatctcgaaggccaagggacagccgagggagcctcaagtatacacgctgccgccatcgagagaagaa
atgaccaaaaaccaggtgtccctttggtgtttggtgaagggtttctatccctccgatatcgccgtagagtgggagtcaaatggacagcctgagaacaa
ctataagactacgcccccctgtgttggacagcgatgggtcattctttctgtattcgaaactcacggtggataagtcgcgatggcaacagggcaatgtgt
tttcgtgcagcgtgatgcatgaggcgctgcacaaccactatactcagaaatcgttaagcttatcgggagagtgt

Fig. 10
(Cont'd)

SEQ ID NO:218 (encodes SEQ ID NO:219):
gaaccgaaatcatgcgacaaaacgcacacttgtccttcctgccctgccccggagttccttggcggaccctcggtctttttgtttccgccgaaaccgaa
agacacccttatgattagcaggacacccgaagtcacgtgtgtcgtcgtggacgtgtcgcaagaggatcccgaggtgcagttcaactggtacgtggacg
gggtagaagtccacaatgccaagacaaaaccccgggaagaacagtttaactcgaagtaccgcgtagtgtcagtcttgacagtcctccatcaggactgg
cttaacgggaaggagtacaaatgtaaagtgtcaaacaagggtctgccttccagcattgagaaaacgatctccaaggctaaagggcagccccgagaacc
acaagtctatacgcttccaccatcgcgggaggagatgaccaagaaccaggtccacttgacctgtctcgtgaaggggttctacccgtcagatatcgcgg
tagagtgggaatcgaacggccagcccgagaataactacaagacgactcctccggtcctcgattcagatgggtcgttcgcactctactcaaaacttacg
gtggacaagtcgagatggcagcagggcaacgtgtttagctgctcagtcatgcacgaggcgctgcataatcactatacacagaagtcgctgtcattgtc
aaaaagctgcgacaagacaggggtggaggttcaggcggtggtgggtcgggagggggagggtcaggtggaggcggcagcgggggtgggggatcgggag
gaggagggtccgggggagggggttccggagggggtgggtcctgtccgtcgtgccctgcaccggaattcttgggcggtccgtcagtgttcctgtttccc
ccgaaacccaaagatacgctcatgatttcccgcacccctgaggtcacttgcgtggtagtcgatgtcagccaggaagatcccgaagtacagttcaattg
gtacgtagatggtgtagaagtacacaacgctaaaactaagcctcgcgaagagcagttcaattcgaagtatcgggtagtaagcgtgctgactgtgctcc
atcaagactggctgaatggaaaagagtataagtgcaaagtctcgaataagggattgcccagctccatcgagaaaaccatctcgaaagcgaagggacag
cccagagaaccccaagtgaccacattgccaccctcccgagaggaaatgactaagaatcaagtgtcactcacatgtcttgtgaagggattctatcccag
cgacatcgccgtcgagtgggagtccaatgggcagccggaaaacaattacaaaacgtttccacccgtccttgactcagatggatcgttctttctctatt
cgaagctcacggtagataagtcgaggtggcaacaaggaaatgtgttttcatgttcggtgatgcatgaagcgctccataaccactatacgcagaaatcg
ctttcgctctccggtgaatgc SEQ ID NO:220 (encodes SEQ ID NO:221):
gaaccgaaatcatgcgacaaaacgcacacttgtccttcctgccctgccccggagttccttggcggaccctcggtctttttgtttccgccgaaaccgaa
agacacccttatgattagcaggacacccgaagtcacgtgtgtcgtcgtggacgtgtcgcaagaggatcccgaggtgcagttcaactggtacgtggacg
gggtagaagtccacaatgccaagacaaaaccccgggaagaacagtttaactcgaagtaccgcgtagtgtcagtcttgacagtcctccatcaggactgg
cttaacgggaaggagtacaaatgtaaagtgtcaaacaagggtctgccttccagcattgagaaaacgatctccaaggctaaaggacagccaagagagcc
tcaagtctatacattgcccccgagccgggaggaaatgaccaaaaaccaggtatcgcttacgtgcttggtggacgggttttacccttcagacatcgcag
tggagtgggaatccaacgggcagccagagaacaattacgataccactccacccgtgcttgacagcgatggctcattcttcctctattccgacttgacc
gtcgataagtcacgatggcagcaggggaatgtgtttagctgttcggtcatgcacgaagcgctgcacaaccactacacgcagaagtcgctctcattgtc
caaaagctgcgacaagacaggggtggaggttcaggcggtggtgggtcgggagggggagggtcaggtggaggcggcagcgggggtgggggatcgggag
gaggagggtccgggggagggggttccggagggggtgggtcctgtccgtcgtgccctgcaccggaattcttgggcggtccgtcagtgttcctgtttccc
ccgaaacccaaagatacgctcatgatttcccgcacccctgaggtcacttgcgtggtagtcgatgtcagccaggaagatcccgaagtacagttcaattg
gtacgtagatggtgtagaagtacacaacgctaaaactaagcctcgcgaagagcagttcaattcgaagtatcgggtagtaagcgtgctgactgtgctcc
atcaagactggctgaatggaaaagagtataagtgcaaagtctcgaataagggattgcccagctccatcgagaaaaccatctcgaaagcgaagggacag
cccagagaaccccaagtgtatacgcttccccttcaagaaagaagatgactaagaatcaggtgtcactcacgtgcctcgtgaagggattctatccgtc
ggacatcgcggtcgaatgggagtcgaatggacagccggagaacaactacaagacaacacctccagtgctgaaatcggatgggagcttctttctgtatt
cgaagctcacggtagataagtcgaggtggcaacaaggaaatgtgttttcatgttcggtgatgcatgaagcgctccataaccactatacgcagaaatcg
ctttcgctctccggtgaatgc Fig. 10
(Cont'd)

Nucleotide sequences encoding the proteins provided in Example 3:

SEQ ID NO:230 (encodes SEQ ID NO:231):
gacattcagatgacacagtcgccgtcgtcgcttagcgcgtcagtgggagatagggtgacgattacgtgcaagtcatcccagtcgctgttgtatacatc
gagccagaagaactacctcgcgtggtaccaacagaagccggggaaagcgcccaaactcctgatctattgggcctcgaccagagagtccggagtaccat
cgcgcttctcaggcagcgggagcgggacggacttcacactgacgatctcctccttgcaacccgaagattttgctacgtattactgtcaacaatactat
gcctacccctggacctttggccagggtactaaggtcgagatcaaacgtacggtggccgctccctccgtctttatctttcctccaagcgacgagcagct
gaagtctggcaccgcaagtgtggtgtgtctgctgaacaatttctaccccagggaagccaaagtgcaatggaaagtggataacgctctgcagtcaggaa
attcccaggagagcgtcacagaacaagactctaaagatagtacttattcactgtccagcaccctgacactgtctaaggccgattatgagaaacacaag
gtgtatgcctgtgaagtcactcatcaggggctgagttcacctgtgaccaaatcctttaacagaggtgagtgc SEQ ID NO:246 (encodes SEQ ID NO:247):
atgggcacccccgcacagctcttgttcttgctgcttctttggctccctgacacaactggtgacattcagatgacacagtcgccgtcgtcgcttagcgc
gtcagtgggagatagggtgacgattacgtgcaagtcatcccagtcgctgttgtatacatcgagccagaagaactacctcgcgtggtaccaacagaagc
cggggaaagcgcccaaactcctgatctattgggcctcgaccagagagtccggagtaccatcgcgcttctcaggcagcgggagcgggacggacttcaca
ctgacgatctcctccttgcaacccgaagattttgctacgtattactgtcaacaatactatgcctacccctggacctttggccagggtactaaggtcga
gatcaaacgtacggtggccgctccctccgtctttatctttcctccaagcgacgagcagctgaagtctggcaccgcaagtgtggtgtgtctgctgaaca
atttctaccccagggaagccaaagtgcaatggaaagtggataacgctctgcagtcaggaaattcccaggagagcgtcacagaacaagactctaaagat
agtacttattcactgtccagcaccctgacactgtctaaggccgattatgagaaacacaaggtgtatgcctgtgaagtcactcatcaggggctgagttc
acctgtgaccaaatcctttaacagaggtgagtgc SEQ ID NO:222 (encodes SEQ ID NO:223):
gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggta

*Fig. 10*
(Cont'd)

SEQ ID NO:244 (encodes SEQ ID NO:245):
atgggctttggactttcgtggctttttctcgtagcgattttgaagggcgtgcagtgcgaggtgcaactggtagaaagcggaggtggtcttgtacagcc
cggtggttcactcagactgtcgtgcgcagcttcagggtatacgttcacctcctactggctccattgggtgcgacaggctccggggaaaggactggaat
gggtcgggatgattgatccgtcgaattcggatactaggttcaatcccaacttcaaggaccggtttaccattagcgcggatacctcgaaaaacaccgca
tatctccaaatgaactcgttgagagccgaggacacggcggtgtattactgcgcaagatacgggtcgtatgtgtcaccgttggactactggggccaggg
gacactggtaacggtcagctcagctagcacgaagggacctagcgtgttcccattggcgcccagctcgaaatccacatcgggcggaacggcagcccttg
ggtgcctcgtgaaagactactttcccgaaccggtgactgtgtcgtggaattcaggggcattgacttccggtgtccacacatttccagccgtgctgcag
tccagcgggttgtattcgctctcgtcagtggtcacagtcccatcctcctcgctcggaacacaaacctatatctgtaatgtcaaccataaaccttcaaa
tacaaaagtggacaaaaaggta SEQ ID NO:286 (encodes SEQ ID NO:287):
caggtacaacttgtgcagtcaggagcggaggtgaagaagcctggtgcatcggtcaaagtgtcatgcaaagcctcggggtacatctttactgcgtacac
aatgcactgggtcagacaggctccgggacaaggtctggaatggatggggtggatcaagcccaataacgggctcgcgaattacgcccagaaattccagg
ggagagtgactatgacaagggatacgagcatttcgacggcgtatatggagctctcgcgcctgcggtcagatgacacagccgtatactattgcgcgcga
tcggaaatcaccaccgaattcgactattggggtcagggaactcttgtcacggtatccagcgctagcaccaagggcccgtcagtattcccgcttgcacc
ctcgtcgaaatcaacatcgggcggaacagcagcccttggctgcttggtaaaagactacttcccagagccagtaacggtatcgtggaattccggagctc
ttacgtcgggggtccatacatttcccgcggtactccaatcgtcgggactgtactcattgtcgtcagtcgtgaccgtgccatccagctccttgggaacc
cagacttacatctgcaacgtcaaccacaagccctcgaacactaaagtggacaagaaagtg SEQ ID NO:255 (encodes SEQ ID NO:256):
atgggattcggactctcctggttgtttttggtggcaattctcaagggcgtccaatgtcaggtacaacttgtgcagtcaggagcggaggtgaagaagcc
tggtgcatcggtcaaagtgtcatgcaaagcctcggggtacatctttactgcgtacacaatgcactgggtcagacaggctccgggacaaggtctggaat
ggatggggtggatcaagcccaataacgggctcgcgaattacgcccagaaattccaggggagagtgactatgacaagggatacgagcatttcgacggcg
tatatggagctctcgcgcctgcggtcagatgacacagccgtatactattgcgcgcgatcggaaatcaccaccgaattcgactattggggtcagggaac
tcttgtcacggtatccagcgctagcaccaagggcccgtcagtattcccgcttgcaccctcgtcgaaatcaacatcgggcggaacagcagcccttggct
gcttggtaaaagactacttcccagagccagtaacggtatcgtggaattccggagctcttacgtcgggggtccatacatttcccgcggtactccaatcg
tcgggactgtactcattgtcgtcagtcgtgaccgtgccatccagctccttgggaacccagacttacatctgcaacgtcaaccacaagccctcgaacac
taaagtggacaagaaagtg Fig. 10
(Cont'd)

SEQ ID NO:288 (encodes SEQ ID NO:289):
gacatcgtgctgacccagtcaccggattcgcttgcagtctcactgggagagagagccacgatcaattgcaagtcctcggaatcagtggacagctacgc
taactcattcatgcactggtatcagcagaagcctggccagccgcccaagttgctgatctaccgcgcaagcacacgggagtcgggggtgccagataggt
tttccggatcgggttcccgaacggacttcacactcacgatttcatccttgcaagccgaagatgtggcggtctattactgtcaacagtcgaaagaggat
ccccttacttttggtggggggtactaaagtagagattaagcgtacggtggcagcgccgtcagtctttatcttccctccttcggatgagcagcttaagag
cgggacagcctcagtagtctgccttctcaacaacttttacccgagagaggccaaggtgcagtggaaggtggataatgccttgcagtcagggaactcac
aagaatcggtcacagaacaggactccaaagatagcacttattccctgtcaagcacgctcactttgtccaaagcggactacgagaagcacaaagtgtac
gcttgcgaggtgactcatcaaggattgtcgagccccgtaacgaagagcttcaatcggggcgagtgt SEQ ID NO:344 (encodes SEQ ID NO:345):
atggggacccctgcgcagttgcttttcctcctccttctctggttgcccgacacgacaggagacatcgtgctgacccagtcaccggattcgcttgcagt
ctcactgggagagagagccacgatcaattgcaagtcctcggaatcagtggacagctacgctaactcattcatgcactggtatcagcagaagcctggcc
agccgcccaagttgctgatctaccgcgcaagcacacgggagtcgggggtgccagataggttttccggatcgggttcccgaacggacttcacactcacg
atttcatccttgcaagccgaagatgtggcggtctattactgtcaacagtcgaaagaggatccccttacttttggtggggggtactaaagtagagattaa
gcgtacggtggcagcgccgtcagtctttatcttccctccttcggatgagcagcttaagagcgggacagcctcagtagtctgccttctcaacaactttt
acccgagagaggccaaggtgcagtggaaggtggataatgccttgcagtcagggaactcacaagaatcggtcacagaacaggactccaaagatagcact
tattccctgtcaagcacgctcactttgtccaaagcggactacgagaagcacaaagtgtacgcttgcgaggtgactcatcaaggattgtcgagccccgt
aacgaagagcttcaatcggggcgagtgt SEQ ID NO:232 (encodes SEQ ID NO:233):
caagtccagttgcaagaaagcgggccaggactcgtgaaaccctcggaaaccctgtcactgacgtgcacggtgagcggagggtccgtgtcgagcggaga
ttactattggacttggattagacagtcgcccggaaaaggtctggagtggatcggacacatctactactcggggaatacgaattacaacccgtcgttga
aatcacggctcacgattagcatcgatacctccaagacgcagttctcgctcaaacttagctccgtaactgcggccgacaccgcaatctactattgtgta
cgcgaccgcgtcacaggggcttttgacatttggggtcagggcactatggtgacctcgtcagcgtcgacaggtggtggggggatcaggaggaggtggctc
cggggggaggcggaagcggcggtgggggctccgacatccagatgacgcagtcgccctcatcattgtcagcatcagtcggggacagggtcactattactt
gtcaggccagccaagatatctcgaactatctgaactggtatcagcagaagcctggaaaagcgcctaagctccttatctatgatgcgtccaatcttgag
acaggggtgccgtcgcggttttccggttcagggtcgggaacggacttcacgtttacaatctccagcctgcagccggaggacgaagccacctacttctg
ccaacacttcgaccatttgcctcttgcgttcggaggtgggacaaaggtggagatcaagcgaact Fig. 10
(Cont'd)

SEQ ID NO:236 (encodes SEQ ID NO:237):
gaggtgcaactggtccagtcaggggcggaggtcaagaagcccggaagctccgtaaaggtatcatgcaaggcctcgggtggaaccttctcctcgtacgc
catcggttgggtgagacaagctcccgggcagggcctcgaatggatgggcggaatcattcccatctttggaatcgcgaactatgcgcagaaatttcagg
gtagagtaacgattacagcggatgaatcgacttcgtccgcatacatggagctttcgtcacttcggtcagaggacactgccgtgtattactgtgcgcgg
gaggaaggcccgtattgtagctcgacctcgtgctacgctgcctttgacatttgggggcagggaacacttgtcacagtatcgagcgcgtccacgggcgg
aggggaagcggaggtggggggatcgggaggggggaggatcaggggggaggggctcccagagcgtgttgacccaagatccagctgtgtccgtcgcactgg
gacagacggtcaaaatcacgtgccagggtgactcgcttcgctcgtacttcgcgtcatggtatcagcaaaaacctggtcaggcaccgacgttggtgatg
tacgcaaggaatgatcgacctgccggggtcccggacaggttctcggggagcaagagcgggacatccgcgtcgttggcgatctccggcctccagcccga
agatgaggccgattactattgtgcagcgtgggacgactcactgaacgggtatctcttcggggcaggcactaaactcacggtgctg SEQ ID NO:257 (encodes SEQ ID NO:258):
caggtgcagctggtggagagcggcggcggcgtggtgcagcccggcgagagcctgagactgagctgcgccgtgagcggcttcagcctgaccaactacgg
cgtgcactgggtgagacaggcccccggcaagggcctggagtgggtgggcgtgatctggagcggcggcaacaccgactacaacaccccttcaccagca
gattcaccatcagcaaggacaacagcaagaacaccgtgtacctgcagatgaacagcctgagagccgaggacaccgccgtgtactactgcgccagagcc
ctgacctactacgactacgagttcgcctactggggccagggcaccctggtgaccgtgagcagcgccagcaccggcggcggcggcagcggcggcggcgg
cagcggcggcggcggcagcggcggcggcggcagcgacatcgtgctgacccagagccccgacttccagagcgtgaccccggcgagaaggtgaccatca
cctgcagagccagccagagcatcggcaccaacatccactggtaccagcagaagcccgaccagagccccaagctgctgatcaagtacgccagcgagagc
atcagcggcgtgcccagcagattcagcggcagcggcagcggcaccgacttcaccctgaccatcaacagcctggaggccgaggacgaggccacctacta
ctgccagcagaacaacaactggcccaccaccttcggccagggcaccaaggtggagatcaagagaacc SEQ ID NO:274 (encodes SEQ ID NO:275):
caggtgcagctggtggagagcggcggcggcgtggtgcagcccggcgagagcctgagactgagctgcgccgtgagcggcttcagcctgaccaactacgg
cgtgcactgggtgagacaggcccccggcaagggcctggagtgggtgggcgtgatctggagcggcggcaacaccgactacaacaccccttcaccagca
gattcaccatcagcaaggacaacagcaagaacaccgtgtacctgcagatgaacagcctgagagccgaggacaccgccgtgtactactgcgccagagcc
ctgacctactacgactacgagttcgcctactggggccagggcaccctggtgaccgtgagcagcgccagcaccggcggcggcggcagcggcggcggcgg
cagcggcggcggcggcagcggcggcggcggcagcgacatcgtgctgacccagagccccagcagcctgagcgtgacccccggcgagaaggtgaccttca
cctgcagagccagccagagcatcggcaccaacatccactggtaccagcagaagcccggccagagccccaagctgctgatcaagtacgccagcgagagc
atcagcggcgtgcccagcagattcagcggcagcggcagcggcaccgacttcaccctgaccatcaacagcgtggaggccgaggacgaggccacctacta
ctgccagcagaacaacaactggcccaccaccttcggccagggcaccaagctggagatcaagagaacc

*Fig. 10*
(Cont'd)

SEQ ID NO:276 (encodes SEQ ID NO:277):
caggtgcagctggtggagagcggcggcggcgtggtgcagcccggcgagagcctgagaatcagctgcgccgtgagcggcttcagcctgaccaactacgg
cgtgcactgggtgagacaggcccccggcaagggcctggagtggctgggcgtgatctggagcggcggcaacaccgactacaacacccccttcaccagca
gactgaccatcagcaaggacaacagcaagagcaccgtgtacttccagatgaacagcctgagagccgaggacaccgccgtgtactactgcgccagagcc
ctgacctactacgactacgagttcgcctactggggccagggcaccctggtgaccgtgagcagcgccagcaccggcggcggcggcagcggcggcggcgg
cagcggcggcggcggcagcggcggcggcggcagcgacatcgtgctgacccagagccccgacttccagagcgtgacccccggcgagaaggtgaccatca
cctgcagagccagccagagcatcggcaccaacatccactggtaccagcagaagcccgaccagagccccaagctgctgatcaagtacgccagcgagagc
atcagcggcgtgcccagcagattcagcggcagcggcagcggcaccgacttcaccctgaccatcaacagcctggaggccgaggacgaggccacctacta
ctgccagcagaacaacaactggcccaccaccttcggccagggcaccaaggtggagatcaagagaacc SEQ ID NO:278 (encodes SEQ ID NO:279):
caggtgcagctggtggagagcggcggcggcgtggtgcagcccggcgagagcctgagaatcagctgcgccgtgagcggcttcagcctgaccaactacgg
cgtgcactgggtgagacaggcccccggcaagggcctggagtggctgggcgtgatctggagcggcggcaacaccgactacaacacccccttcaccagca
gactgaccatcagcaaggacaacagcaagagcaccgtgtacttccagatgaacagcctgagagccgaggacaccgccgtgtactactgcgccagagcc
ctgacctactacgactacgagttcgcctactggggccagggcaccctggtgaccgtgagcagcgccagcaccggcggcggcggcagcggcggcggcgg
cagcggcggcggcggcagcggcggcggcggcagcgacatcgtgctgacccagagccccagcagcctgagcgtgacccccggcgagaaggtgaccttca
cctgcagagccagccagagcatcggcaccaacatccactggtaccagcagaagcccggccagagccccaagctgctgatcaagtacgccagcgagagc
atcagcggcgtgcccagcagattcagcggcagcggcagcggcaccgacttcaccctgaccatcaacagcgtggaggccgaggacgaggccacctacta
ctgccagcagaacaacaactggcccaccaccttcggccagggcaccaagctggagatcaagagaacc Fig. 10
(Cont'd)

SEQ ID NO:234 (encodes SEQ ID NO:235) (SEQ ID NO:222 (5D5) + SEQ ID NO:180 (AEM1 DiS2)+ G4S
connecting linker + SEQ ID NO:232 (panitumumab)):
gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacggaaagaatacaaatgtaaggtgtccaa
caaggctctcccggcaccgattgagaaaacgatcagcaaggccaaggggcagccccgagaaccccaagtatacacacttccccgtccagggaggaga
tgaccaagaaccaggtgtcgctgtcgtgtgcggtcaaggggttttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcgggggtggagggtccggtggtggtgggagcggaggtggagggagcggtggaggtggtagcgggggaggtggatcgggaggggt
gggagctgtccgccatgtccagccccggaacttctcggggaccgtcagtctttctttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggagggag
cggtggtggggggatcccaagtccagttgcaagaaagcgggccaggactcgtgaaaccctcggaaaccctgtcactgacgtgcacggtgagcggagggt
ccgtgtcgagcggagattactattggacttggattagacagtcgcccggaaaaggtctggagtggatcggacacatctactactcggggaatacgaat
tacaacccgtcgttgaaatcacggctcacgattagcatcgatacctccaagacgcagttctcgctcaaacttagctccgtaactgcggccgacaccgc
aatctactattgtgtacgcgaccgcgtcacaggggcttttgacatttggggtcagggcactatggtgacctcgtcagcgtcgacaggtggtggggat
caggaggaggtggctccgggggaggcggaagcggcggtgggggctccgacatccagatgacgcagtcgccctcatcattgtcagcatcagtcggggac
agggtcactattacttgtcaggccagccaagatatctcgaactatctgaactggtatcagcagaagcctggaaaagcgcctaagctccttatctatga
tgcgtccaatcttgagacaggggtgccgtcgcggttttccggttcagggtcgggaacggacttcacgtttacaatctccagcctgcagccggaggacg
aagccacctacttctgccaacacttcgaccatttgcctcttgcgttcggaggtgggacaaaggtggagatcaagcgaact

*Fig. 10*
(Cont'd)

SEQ ID NO:342 (encodes SEQ ID NO:343) (SEQ ID NO:222 (5D5) + SEQ ID NO:186 (AEM1 + DiS2 inverted) + G4S connecting linker + SEQ ID NO:232 (panitumumab)):

Gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgacaaaacgcacacctgtcc
gccctgtcctgccccggaacttctcggagggccttccgtgtttctcttccctccgaagcccaaggacacgctgatgatctcccggaccccggaggtca
cgtgtgtggtagtagacgtgtcacacgaagatccggaggtgaagttcaactggtacgtagatggcgtggaggtgcacaacgccaaaacgaagccccga
gaggaacagtaccagtcaacgtaccgcgtcgtgtcggtattgactgtattgcatcaagactggttgaacgggaaggagtataagtgtaaagtcagcaa
caaggctcttcccgcacccattgaaaagacaatttcgaaagccaaaggccagcccagggagccccaagtgtacaccctgccacccagccgggaagaga
tgacaaagaatcaagtctcgcttagctgcgctgtcaagggcttctatccatcggacattgcagtggaatgggaatcaaacggacagccggagaataac
tataagacgacacccccctgtcctcgacagcgacgggtcgttcttccttgtgagcaagctcacggtcgacaaaagccgctggcagcagggaaacgtatt
ctcatgttcggtgatgcacgaagcattgcataaccactacacgcagaagagcttgtcgttgagcggggaatgcggagggggagggtccgggggtggtg
ggagcggcggaggaggtagcggcggaggtggctcgggaggaggtgggtcgggtggtggggaagcggaggcggagggtcatgtccgccgtgcccggca
cccgaactgctcggaggtccctcggtgttcctgttcccgccaaagcctaaggatacgttgatgatttcgcgcacgccggaggtaacatgcgtggtggt
ggatgtgtcacatgaggaccccgaggtcaagttcaattggtacgtcgatggagtggaagtgcacaatgcgaaaacaaaaccccgggaggagcagtatc
agagcacgtacagggtagtctccgtcctgactgtacttcaccaagactggcttaacggaaaagagtataagtgcaaggtcagcaacaaggcgcttcct
gcccctatcgagaaaaccatctcgaaggccaagggacagccgagggagcctcaagtatacacgctgccgccatcgagagagaagaaatgaccaaaaacca
ggtgtccctttggtgtttggtgaagggtttctatccctccgatatcgccgtagagtgggagtcaaatggacagcctgagaacaactataagactacgc
cccctgtgttggacagcgatgggtcattctttctgtattcgaaactcacggtggataagtcgcgatggcaacagggcaatgtgttttcgtgcagcgtg
atgcatgaggcgctgcacaaccactatactcagaaatcgttaagcttatcgaagtcatgcgacaagactggaggtggagggagcggtggtgggggatc
ccaagtccagttgcaagaaagcgggccaggactcgtgaaaccctcggaaaccctgtcactgacgtgcacggtgagcggagggtccgtgtcgagcggag
attactattggacttggattagacagtcgcccggaaaaggtctggagtggatcggacacatctactactcggggaatacgaattacaacccgtcgttg
aaatcacggctcacgattagcatcgatacctccaagacgcagttctcgctcaaacttagctccgtaactgcggccgacaccgcaatctactattgtgt
acgcgaccgcgtcacaggggcttttgacatttggggtcagggcactatggtgacctcgtcagcgtcgacaggtggtgggggatcaggaggaggtggct
ccgggggaggcggaagcggcggtgggggctccgacatccagatgacgcagtcgccctcatcattgtcagcatcagtcggggacagggtcactattact
tgtcaggccagccaagatatctcgaactatctgaactggtatcagcagaagcctggaaaagcgcctaagctccttatctatgatgcgtccaatcttga
gacaggggtgccgtcgcggttttccggttcagggtcgggaacggacttcacgtttacaatctccagcctgcagccggaggacgaagccacctacttct
gccaacacttcgaccatttgcctcttgcgttcggaggtgggacaaaggtggagatcaagcgaact

SEQ ID NO:224 (encodes SEQ ID NO:225) (SEQ ID NO:222 (5D5) + SEQ ID NO:171 (AEM-1)+ G4S connecting linker + SEQ ID NO:232 (panitumumab)):

Gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataagacccacacatgccc
tccctgtccagcacccgagctgctcggggaccctcggtgttcttgtttcctcccaaacccaaagataccctatgattagccggacaccagaggtga
cgtgcgtggtagtagacgtgtcccatgaggacccggaggtcaagttcaactggtacgtggacggagtggaggtgcacaatgcaaagaccaagccgagg
gaagagcaataccagtccacatatagagtcgtgtcggtccttacggtcttgcatcaggactggctgaatggcaaagaatacaaatgtaaagtctccaa
caaagctctcccagcgcccattgagaaaacaatctcaaaagcgaaaggccaaccgagagaacctcaagtctatactcttccccgtcgagagaggaaa
tgaccaaaaaccaggtatccctgtcatgcgcggtcaaggggttttacccaagcgacatcgccgtggagtgggagtcgaacggacagccagagaataac
tataagacgacccctcccgtgctggattcggatggatcgttctttcttgtcagcaaactcacagtcgacaaatcaaggtggcagcaagggaacgtgtt
cagctgttcggtaatgcatgaagccctccacaatcactacacgcagaaatccctgtcgctctcaccagggaagggtggggtggctcaggggggtgggg
gatcaggtggtggtggtagcggaggtggagggagcggaggcggaggctccggtggaggaggttccggaggtggcgggtcaggggggaggagggtcatgt
ccgccgtgccctgcccccgaattgctgggaggtccgtccgtatttctgtttccccccgaagcctaaagatactcttatgatctcgcgaacgccggaagt
aacttgtgtcgtggtagatgtctcacacgaagatcccgaagtgaaattcaattggtatgtcgacggcgtggaggtacataacgccaagacgaagccta
gagaggaacagtaccagtcaacgtatcgggtcgtatccgtgctcaccgtgctccaccaggattggctgaacggaaaggagtacaagtgcaaagtctcg
aacaaggcgttgcctgcgccaatcgaaaagacgatctccaaagctaagggacaaccaagggaaccacaagtgtatactctcccgccctcgcgcgaaga
gatgacaaagaatcaggtgtcactttggtgcttggtgaaggggttctatccctcggatattgcggtcgagtgggagagcaatggtcaaccggagaaca
attacaagacgacaccgcccgtattggactccgacgggtccttctttctctactcgaagctcactgtagataagtcgcgatggcagcaggggaacgtc
tttagctgttccgtgatgcacgaggcacttcataaccactatacccagaagtcgttgtcgctttcccccggaaaaggaggtggagggagcggtggtgg
gggatcccaagtccagttgcaagaaagcgggccaggactcgtgaaaccctcggaaaccctgtcactgacgtgcacggtgagcggagggtccgtgtcga
gcggagattactattggacttggattagacagtcgcccggaaaaggtctggagtggatcggacacatctactactcggggaatacgaattacaacccg
tcgttgaaatcacggctcacgattagcatcgatacctccaagacgcagttctcgctcaaacttagctccgtaactgcggccgacaccgcaatctacta
ttgtgtacgcgaccgcgtcacaggggcttttgacatttggggtcagggcactatggtgacctcgtcagcgtcgacaggtggtgggggatcaggaggag
gtggctccgggggaggcggaagcggcggtgggggctccgacatccagatgacgcagtcgccctcatcattgtcagcatcagtcggggacagggtcact
attacttgtcaggccagccaagatatctcgaactatctgaactggtatcagcagaagcctggaaaagcgcctaagctccttatctatgatgcgtccaa
tcttgagacaggggtgccgtcgcggttttccggttcagggtcgggaacggacttcacgtttacaatctccagcctgcagccggaggacgaagccacct
acttctgccaacacttcgaccatttgcctcttgcgttcggaggtgggacaaaggtggagatcaagcgaact

SEQ ID NO:226 (encodes SEQ ID NO:227) (SEQ ID NO:222 (5D5) + SEQ ID NO:196 (IgG1/IgG4 AEM1) + G4S connecting linker + SEQ ID NO:232 (panitumumab)):

Gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgacaagacccatacatgccc
aagctgtcccgctccggagtttctcggtggaccgtcggtgtttctgttccctccgaagccaaaagataccttgatgatttcgcgaactcccgaagtca
cgtgtgtcgtcgtggacgtaagccaggaggacccggaggtccagttcaattggtatgtagacggcgtagaggtacataatgcgaaaacgaagcccaga
gaggaacagttcaatagcaaataccgcgtagtatcggtgctgacagtgttgcaccaggactggctgaatggaaaagaatacaagtgtaaagtgtccaa
caagggccttccatcgtcgattgaaaagacaatctccaaggcaaaggggcagcctagggagccccaagtctacaccctgcccccttcgcgggaggaga
tgacgaagaaccaggtatcactgtcatgcgcggtcaaaggatttacccgagcgacatcgccgtagaatgggagtccaacggacagccagaaaacaat
tacaagaccactcctccagtgctcgatagcgatggctccttctttcttgtcagcaaattgacagtcgataagtcaagatggcagcagggtaatgtgtt
ctcatgtagcgtcatgcacgaagcactccacaatcattatacacagaagagcctctcgttgtcgcccggaaaaggcggaggtgggtcgggcggagggg
gaagcggtggaggagggtcaggaggtggaggttccgggggaggcggttcgggaggaggggttcgggtggtggaggatcgggtggcggaggaagctgc
ccttcatgtccagcccccgagttcctcggaggcccgtcggtctttctttttcccccctaagcctaaagataccctgatgatcagccggacgcctgaggt
gacttgtgtggtagtcgacgtgtcccaagaagatccggaagtccagtttaactggtatgtggatggagtggaggtccataatgccaagacaaagccaa
gggaggagcaattcaactcgaagtaccgcgtcgtgtccgtgctcacagtgcttcatcaagactggttgaacggaaaggagtacaaatgtaaggtatca
aacaagggtttgccctcgtccatcgagaaaaccatctcgaaagcgaaagggcaaccccgcgagccccaggtatatacgctcccgccttcaagagaaga
aatgacgaaaaaccaagtgagcttgtggtgcctggtcaaggggttctatccctccgatatcgcggtagagtgggaaagcaatgggcagccggagaaca
actataagacaacgcctcccgtgttggactcagatggatcgttcttcttgtactcaaagcttacggtggacaagtcacgctggcagcaaggaacgtg
ttttcgtgctcggtgatgcacgaggcgcttcacaatcactacactcagaaatcgcttagcttgtcaccaggaaaaggaggtggagggagcggtggtgg
gggatcccaagtccagttgcaagaaagcgggccaggactcgtgaaaccctcggaaaccctgtcactgacgtgcacggtgagcggagggtccgtgtcga
gcggagattactattggacttggattagacagtcgcccggaaaaggtctggagtggatcggacacatctactactcggggaatacgaattacaacccg
tcgttgaaatcacggctcacgattagcatcgatacctccaagacgcagttctcgctcaaacttagctccgtaactgcggccgacaccgcaatctacta
ttgtgtacgcgaccgcgtcacaggggcttttgacatttggggtcagggcactatggtgacctcgtcagcgtcgacaggtggtgggggatcaggaggag
gtggctccgggggaggcggaagcggcggtgggggctccgacatccagatgacgcagtcgccctcatcattgtcagcatcagtcggggacagggtcact
attacttgtcaggccagccaagatatctcgaactatctgaactggtatcagcagaagcctggaaaagcgcctaagctccttatctatgatgcgtccaa
tcttgagacaggggtgccgtcgcggttttccggttcagggtcgggaacggacttcacgtttacaatctccagcctgcagccggaggacgaagccacct
acttctgccaacacttcgaccatttgcctcttgcgttcggaggtgggacaaaggtggagatcaagcgaact

*Fig. 10*
(Cont'd)

SEQ ID NO:228 (encodes SEQ ID NO:229)(SEQ ID NO:222 (5D5) + SEQ ID NO:196 (IgG1/IgG4 AEM1)+ G4S connecting linker + SEQ ID NO:232 (panitumumab)):

Gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgacaagacccatacatgccc
aagctgtcccgctccggagtttctcggtggaccgtcggtgtttctgttccctccgaagccaaaagataccttgatgatttcgcgaactcccgaagtca
cgtgtgtcgtcgtggacgtaagccaggaggacccggaggtccagttcaattggtatgtagacggcgtagaggtacataatgcgaaaacgaagcccaga
gaggaacagttcaatagcaaataccgcgtagtatcggtgctgacagtgttgcaccaggactggctgaatggaaaagaatacaagtgtaaagtgtccaa
caagggccttccatcgtcgattgaaaagacaatctccaaggcaaaggggcagcctagggagccccaagtctacaccctgccccttcgcgggaggaga
tgacgaagaaccaggtatcactgtcatgcgcggtcaaaggatttacccgagcgacatcgccgtagaatgggagtccaacggacagccagaaaacaat
tacaagaccactcctccagtgctcgatagcgatggctccttctttcttgtcagcaaattgacagtcgataagtcaagatggcagcagggtaatgtgtt
ctcatgtagcgtcatgcacgaagcactccacaatcattatacacagaagagcctctcgttgtcgcccggaaaaggcggaggtgggtcgggcggagggg
gaagcggtggaggagggtcaggaggtggaggttccgggggaggcggttcgggaggaggggggttcgggtggtggaggatcgggtggcggaggaagctgc
ccttcatgtccagcccccgagttcctcggaggcccgtcggtctttcttttcccccctaagcctaaagataccctgatgatcagccggacgcctgaggt
gacttgtgtggtagtcgacgtgtcccaagaagatccggaagtccagtttaactggtatgtggatggagtggaggtccataatgccaagacaaagccaa
gggaggagcaattcaactcgaagtaccgcgtcgtgtccgtgctcacagtgcttcatcaagactggttgaacggaaaggagtacaaatgtaaggtatca
aacaagggtttgccctcgtccatcgagaaaaccatctcgaaagcgaaagggcaaccccgcgagccccaggtatatacgctcccgccttcaagagaaga
aatgacgaaaaaccaagtgagcttgtggtgcctggtcaaggggttctatccctccgatatcgcggtagagtgggaaagcaatgggcagccggagaaca
actataagacaacgcctcccgtgttggactcagatggatcgttcttcttgtactcaaagcttacggtggacaagtcacgctggcagcaagggaacgtg
ttttcgtgctcggtgatgcacgaggcgcttcacaatcactacactcagaaatcgcttagcttgtcaccaggaaaaggaggtggagggagcggtggtgg
gggatcccaagtccagttgcaagaaagcgggccaggactcgtgaaaccctcggaaaccctgtcactgacgtgcacggtgagcggagggtccgtgtcga
gcggagattactattggacttggattagacagtcgcccggaaaaggtctggagtggatcggacacatctactactcggggaatacgaattacaacccg
tcgttgaaatcacggctcacgattagcatcgatacctccaagacgcagttctcgctcaaacttagctccgtaactgcggccgacaccgcaatctacta
ttgtgtacgcgaccgcgtcacaggggcttttgacatttggggtcagggcactatggtgacctcgtcagcgtcgacaggtggtggggggatcaggaggag
gtggctccgggggaggcggaagcggcggtggggctccgacatccagatgacgcagtcgccctcatcattgtcagcatcagtcggggacagggtcact
attacttgtcaggccagccaagatatctcgaactatctgaactggtatcagcagaagcctggaaaagcgcctaagctccttatctatgatgcgtccaa
tcttgagacaggggtgccgtcgcggttttccggttcagggtcgggaacggacttcacgtttacaatctccagcctgcagccggaggacgaagccacct
acttctgccaacacttcgaccatttgcctcttgcgttcggaggtgggacaaaggtggagatcaagcgaact Fig. 10
(Cont'd)

SEQ ID NO:238 (encodes SEQ ID NO:239) (SEQ ID NO:222 (5D5)+ SEQ ID NO:180 + G4S connecting linker + SEQ ID NO:237 (2224)):

gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacgggaaagaatacaaatgtaaggtgtccaa
caaggctctcccggcaccgattgagaaaacgatcagcaaggccaaggggcagccccgagaaccccaagtatacacacttcccccgtccagggaggag
tgaccaagaaccaggtgtcgctgtcgtgtgcggtcaaggggttttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcgggggtggagggtccggtggtggtgggagcggaggtggagggagcggtggaggtggtagcgggggaggtggatcgggaggggt
gggagctgtccgccatgtccagccccggaacttctcggggaccgtcagtctttctttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggtttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggagggag
cggtggtggggggatccgaggtgcaactggtccagtcaggggcggaggtcaagaagcccggaagctccgtaaaggtatcatgcaaggcctcgggtggaa
ccttctcctcgtacgccatcggttgggtgagacaagctcccgggcagggcctcgaatggatgggcggaatcattcccatctttggaatcgcgaactat
gcgcagaaatttcagggtagagtaacgattacagcggatgaatcgacttcgtccgcatacatggagctttcgtcacttcggtcagaggacactgccgt
gtattactgtgcgcgggaggaaggcccgtattgtagctcgacctcgtgctacgctgcctttgacatttggggggcagggaacacttgtcacagtatcga
gcgcgtccacgggcggaggggggaagcggaggtgggggatcgggagggggaggatcaggggggagggggctcccagagcgtgttgacccaagatccagct
gtgtccgtcgcactgggacagacggtcaaaatcacgtgccagggtgactcgcttcgctcgtacttcgcgtcatggtatcagcaaaaacctggtcaggc
accgacgttggtgatgtacgcaaggaatgatcgacctgccggggtcccggacaggttctcggggagcaagagcgggacatccgcgtcgttggcgatct
ccggcctccagcccgaagatgaggccgattactattgtgcagcgtgggacgactcactgaacgggtatctcttcggggcaggcactaaactcacggtg
ttg

SEQ ID NO:259 (encodes SEQ ID NO:260) ( SEQ ID NO:222 (5D5) + SEQ ID NO:180 + G4S connecting linker + SEQ ID NO:257 (cetuximab H1L1)):

gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacgggaaagaatacaaatgtaaggtgtccaa
caaggctctcccggcaccgattgagaaaacgatcagcaaggccaaggggcagccccgagaaccccaagtatacacacttcccccgtccagggaggaga
tgaccaagaaccaggtgtcgctgtcgtgtgcggtcaaggggtttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcggggtggagggtccggtggtggtgggagcggaggtggagggagcggtggaggtggtagcggggaggtggatcggaggggt
gggagctgtccgccatgtccagccccggaacttctcggggaccgtcagtctttctttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggtttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggaggggag
cggtggtggggggatcccaggtgcagctggtggagagcggcggcggcgtggtgcagcccggcgagagcctgagactgagctgcgccgtgagcggcttca
gcctgaccaactacggcgtgcactgggtgagacaggcccccggcaagggcctggagtgggtgggcgtgatctggagcggcggcaacaccgactacaac
accccttcaccagcagattcaccatcagcaaggacaacagcaagaacaccgtgtacctgcagatgaacagcctgagagccgaggacaccgccgtgta
ctactgcgccagagccctgacctactacgactacgagttcgcctactggggccagggcaccctggtgaccgtgagcagcgccagcaccggcggcggcg
gcagcggcggcggcggcagcggcggcggcggcagcggcggcggcggcagcgacatcgtgctgacccagagccccgacttccagagcgtgacccccggc
gagaaggtgaccatcacctgcagagccagccagagcatcggcaccaacatccactggtaccagcagaagcccgaccagagccccaagctgctgatcaa
gtacgccagcgagagcatcagcggcgtgcccagcagattcagcggcagcggcagcggcaccgacttcaccctgaccatcaacagcctggaggccgagg
acgaggccacctactactgccagcagaacaacaactggcccaccaccttcggccagggcaccaaggtggagatcaagagaacc

SEQ ID NO:280 (encodes SEQ ID NO:281)(SEQ ID NO:222 (5D5) + SEQ ID NO:180 + G4S connecting linker + SEQ ID NO:274 (cetuximab H1L2)):

gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacgggaaagaatacaaatgtaaggtgtccaa
caaggctctcccggcaccgattgagaaaacgatcagcaaggccaaggggcagccccgagaaccccaagtatacacacttcccccgtccagggaggaga
tgaccaagaaccaggtgtcgctgtcgtgtgcggtcaaggggttttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcggggggtggagggtccggtggtggtgggagcggaggtggagggagcggtggaggtggtagcggggaggtggatcgggaggggt
gggagctgtccgccatgtccagccccggaacttctcggggaccgtcagtctttcttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggagggag
cggtggtgggggatcccaggtgcagctggtggagagcggcggcggcgtggtgcagcccggcgagagcctgagactgagctgcgccgtgagcggcttca
gcctgaccaactacggcgtgcactgggtgagacaggcccccggcaagggcctggagtgggtgggcgtgatctggagcggcggcaacaccgactacaac
accccttcaccagcagattcaccatcagcaaggacaacagcaagaacaccgtgtacctgcagatgaacagcctgagagccgaggacaccgccgtgta
ctactgcgccagagccctgacctactacgactacgagttcgcctactggggccagggcaccctggtgaccgtgagcagcgccagcaccggcggcggcg
gcagcggcggcggcggcagcggcggcggcggcagcggcggcggcggcagcgacatcgtgctgacccagagccccagcagcctgagcgtgacccccggc
gagaaggtgaccttcacctgcagagccagccagagcatcggcaccaacatccactggtaccagcagaagcccggccagagccccaagctgctgatcaa
gtacgccagcgagagcatcagcggcgtgcccagcagattcagcggcagcggcagcggcaccgacttcaccctgaccatcaacagcgtggaggccgagg
acgaggccacctactactgccagcagaacaacaactggcccaccaccttcggccagggcaccaagctggagatcaagagaacc

*Fig. 10*
(Cont'd)

SEQ ID NO:282 (encodes SEQ ID NO:283)( SEQ ID NO:222 (5D5) + SEQ ID NO:180 + G4S connecting linker + SEQ ID NO:276 (cetuximab H2L1)):
gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacgggaaagaatacaaatgtaaggtgtccaa
caaggctctcccggcaccgattgagaaaacgatcagcaaggccaaggggcagccccgagaaccccaagtatacacacttcccccgtccagggaggaga
tgaccaagaaccaggtgtcgctgtcgtgtgcggtcaaggggttttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcgggggtggagggtccggtggtggtggagcggaggtggagggagcggtggaggtggtagcggggaggtggatcggggaggggggt
gggagctgtccgccatgtccagccccggaacttctcggggggaccgtcagtctttctttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggtttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggagggag
cggtggtggggggatcccaggtgcagctggtggagagcggcggcggcgtggtgcagcccggcgagagcctgagaatcagctgcgccgtgagcggcttca
gcctgaccaactacggcgtgcactgggtgagacaggcccccggcaagggcctggagtggctgggcgtgatctggagcggcggcaacaccgactacaac
acccccttcaccagcagactgaccatcagcaaggacaacagcaagagcaccgtgtacttccagatgaacagcctgagagccgaggacaccgccgtgta
ctactgcgccagagccctgacctactacgactacgagttcgcctactggggccagggcaccctggtgaccgtgagcagcgccagcaccggcggcggcg
gcagcggcggcggcggcagcggcggcggcggcagcggcggcggcggcagcgacatcgtgctgacccagagccccgacttccagagcgtgacccccggc
gagaaggtgaccatcacctgcagagccagccagagcatcggcaccaacatccactggtaccagcagaagcccgaccagagccccaagctgctgatcaa
gtacgccagcgagagcatcagcggcgtgcccagcagattcagcggcagcggcagcggcaccgacttcaccctgaccatcaacagcctggaggccgagg
acgaggccacctactactgccagcagaacaacaactggcccaccaccttcggccagggcaccaaggtggagatcaagagaacc

*Fig. 10*
(Cont'd)

SEQ ID NO:284 (encodes SEQ ID NO:285)( SEQ ID NO:222 (5D5) + SEQ ID NO:180 + G4S connecting linker + SEQ ID NO:278 (cetuximab H2L2)):

gaggtgcaactggtagaaagcggaggtggtcttgtacagcccggtggttcactcagactgtcgtgcgcagcttcaggctatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccagggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataaaacacacacatgccc
accatgcccagcgcctgaacttttgggaggtccctcggtgtttttgtttcctcctaagcctaaggacaccctgatgatctcccgcactccggaagtga
cgtgtgtcgtagtcgacgtcagccatgaggaccctgaggtgaaattcaactggtacgtagatggtgtggaggtgcataatgcaaaaactaagcctcgg
gaggaacaatatcaaagcacataccgggtcgtgtccgtgctcacggtacttcatcaggattggctcaacgggaaagaatacaaatgtaaggtgtccaa
caaggctctcccggcaccgattgagaaaacgatcagcaaggccaaggggcagccccgagaaccccaagtatacacacttcccccgtccagggaggaga
tgaccaagaaccaggtgtcgctgtcgtgtgcggtcaaggggttttatcccagcgacatcgcggtagagtgggagtcgaacggccagcccgagaacaac
tacaagacaacaccgcctgtattggactcggacgggtcgtttttcctggtcagcaagctcacagtggataaaagccgctggcagcaggggaatgtatt
ctcctgctccgtcatgcacgaggcgcttcacaaccattacacgcaaaaatccctgtccttgtccaagtcatgcgacaagacgggaggaggagggtcag
gcggaggaggaagcgggggtggagggtccggtggtggtgggagcggaggtggagggagcggtggaggtggtagcgggggaggtggatcgggaggggggt
gggagctgtccgccatgtccagccccggaacttctcggggaccgtcagtctttcttttttccgccgaagcccaaggacaccttgatgattagccgcac
gccggaggtcacgtgcgtagtagtggatgtatcccacgaggaccccgaggtcaaattcaattggtatgtcgacggagtggaagtacacaacgcaaaga
caaagccgagagaagagcagtaccaatccacttatagggtagtctcggtcttgacagtactgcaccaggactggcttaatggaaaggaatacaagtgc
aaagtctcaaacaaagccctccccgcacccatcgaaaagacaatctcgaaagcgaaaggacagcccagagagcctcaagtgtataccctgcccccgtc
aagagaagagatgacgaagaaccaagtgtccctctggtgtctcgtgaaaggttttaccccagcgatattgccgtcgaatgggaaagcaatggtcagc
ccgaaaacaattacaagactacgcctcccgtattggattcggatggttcgttcttcttgtactcaaagcttactgtcgataagtcgcggtggcagcaa
ggcaatgtgtttagctgttcggtaatgcatgaggcgctccacaatcactatacacagaagagcttgtccctcagcggggagtgcggaggtggagggag
cggtggtgggggatcccaggtgcagctggtggagagcggcggcggcgtggtgcagcccggcgagagcctgagaatcagctgcgccgtgagcggcttca
gcctgaccaactacggcgtgcactgggtgagacaggcccccggcaagggcctggagtggctgggcgtgatctggagcggcggcaacaccgactacaac
acccccttcaccagcagactgaccatcagcaaggacaacagcaagagcaccgtgtacttccagatgaacagcctgagagccgaggacaccgccgtgta
ctactgcgccagagccctgacctactacgactacgagttcgcctactggggccagggcaccctggtgaccgtgagcagcgccagcaccggcggcggcg
gcagcggcggcggcggcagcggcggcggcggcagcggcggcggcggcagcgacatcgtgctgacccagagccccagcagcctgagcgtgagccccggc
gagaaggtgaccttcacctgcagagccagccagagcatcggcaccaacatccactggtaccagcagaagcccggccagagccccaagctgctgatcaa
gtacgccagcgagagcatcagcggcgtgcccagcagattcagcggcagcggcagcggcaccgacttcaccctgaccatcaacagcgtggaggccgagg
acgaggccacctactactgccagcagaacaacaactggcccaccaccttcggccagggcaccaagctggagatcaagagaacc

Fig. 10
(Cont'd)

SEQ ID NO:290 (encodes SEQ ID NO:291) (SEQ ID NO:284 (c-Met binding site 2) + SEQ ID NO:180 + G4S connecting linker + SEQ ID NO:257 (cetuximab H1L1)):

caggtacaacttgtgcagtcaggagcggaggtgaagaagcctggtgcatcggtcaaagtgtcatgcaaagcctcggggtacatctttactgcgtacac
aatgcactgggtcagacaggctccgggacaaggtctggaatggatggggtggatcaagcccaataacgggctcgcgaattacgcccagaaattccagg
ggagagtgactatgacaagggatacgagcatttcgacggcgtatatggagctctcgcgcctgcggtcagatgacacagccgtatactattgcgcgcga
tcggaaatcaccaccgaattcgactattggggtcagggaactcttgtcacggtatccagcgctagcaccaagggcccgtcagtattcccgcttgcacc
ctcgtcgaaatcaacatcgggcggaacagcagcccttggctgcttggtaaaagactacttcccagagccagtaacggtatcgtggaattccggagctc
ttacgtcgggggtccatacatttcccgcggtactccaatcgtcgggactgtactcattgtcgtcagtcgtgaccgtgccatccagctccttgggaacc
cagacttacatctgcaacgtcaaccacaagccctcgaacactaaagtggacaagaaagtggaaccgaaatcatgcgataaaacacacacatgcccacc
atgcccagcgcctgaactttgggaggtccctcggtgtttttgtttcctcctaagcctaaggacaccctgatgatctcccgcactccggaagtgacgt
gtgtcgtagtcgacgtcagccatgaggaccctgaggtgaaattcaactggtacgtagatggtgtggaggtgcataatgcaaaaactaagcctcgggag
gaacaatatcaaagcacataccgggtcgtgtccgtgctcacggtacttcatcaggattggctcaacgggaaagaatacaaatgtaaggtgtccaacaa
ggctctcccggcaccgattgagaaaacgatcagcaaggccaaggggcagccccgagaaccccaagtatacacacttcccccgtccagggaggagatga
ccaagaaccaggtgtcgctgtcgtgtgcggtcaaggggttttatcccagcgacatcgcggtagagtgggagtcgaacggccagcccgagaacaactac
aagacaacaccgcctgtattggactcggacgggtcgtttttcctggtcagcaagctcacagtggataaaagccgctggcagcaggggaatgtattctc
ctgctccgtcatgcacgaggcgcttcacaaccattacacgcaaaaatccctgtccttgtccaagtcatgcgacaagacgggaggaggagggtcaggcg
gaggaggaagcggggggtggagggtccggtggtggtgggagcggaggtggagggagcggtggaggtggtagcggggggaggtggatcgggaggggggtggg
agctgtccgccatgtccagccccggaacttctcggggggaccgtcagtctttcttttttccgccgaagcccaaggacaccttgatgattagccgcacgcc
ggaggtcacgtgcgtagtagtggatgtatcccacgaggacccgaggtcaaattcaattggtatgtcgacggagtggaagtacacaacgcaaagacaa
agccgagagaagagcagtaccaatccacttatagggtagtctcggtcttgacagtactgcaccaggactggcttaatggaaaggaatacaagtgcaaa
gtctcaaacaaagccctccccgcacccatcgaaaagacaatctcgaaagcgaaaggacagcccagagagcctcaagtgtataccctgccccccgtcaag
agaagagatgacgaagaaccaagtgtccctctggtgtctcgtgaaaggtttttaccccagcgatattgccgtcgaatgggaaagcaatggtcagcccg
aaaacaattacaagactacgcctcccgtattggattcggatggttcgttcttcttgtactcaaagcttactgtcgataagtcgcggtggcagcaaggc
aatgtgtttagctgttcggtaatgcatgaggcgctccacaatcactatacacagaagagcttgtccctcagcggggagtgcggaggtggagggagcgg
tggtgggggatcccaggtgcagctggtggagagcggcggcggcgtggtgcagcccggcgagagcctgagactgagctgcgccgtgagcggcttcagcc
tgaccaactacggcgtgcactgggtgagacaggcccccggcaagggcctggagtgggtgggcgtgatctggagcggcggcaacaccgactacaacacc
cccttcaccagcagattcaccatcagcaaggacaacagcaagaacaccgtgtacctgcagatgaacagcctgagagccgaggacaccgccgtgtacta
ctgcgccagagccctgacctactacgactacgagttcgcctactggggccagggcaccctggtgaccgtgagcagcgccagcaccggcggcggcggca
gcggcggcggcggcagcggcggcggcggcagcggcggcggcggcagcgacatcgtgctgacccagagccccgacttccagagcgtgacccccggcgag
aaggtgaccatcacctgcagagccagccagagcatcggcaccaacatccactggtaccagcagaagcccgaccagagccccaagctgctgatcaagta
cgccagcgagagcatcagcggcgtgcccagcagattcagcggcagcggcagcggcaccgacttcaccctgaccatcaacagcctggaggccgaggacg
aggccacctactactgccagcagaacaacaactggcccaccaccttcggccagggcaccaaggtggagatcaagagaacc

SEQ ID NO:346 (encodes SEQ ID NO:347):
gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgataagacccacacatgccc
tccctgtccagcacccgagctgctcggggggaccctcggtgttcttgtttcctcccaaacccaaagatacccttatgattagccggacaccagaggtga
cgtgcgtggtagtagacgtgtcccatgaggacccggaggtcaagttcaactggtacgtggacggagtggaggtgcacaatgcaaagaccaagccgagg
gaagagcaataccagtccacatatagagtcgtgtcggtccttacggtcttgcatcaggactggctgaatggcaaagaatacaaatgtaaagtctccaa
caaagctctcccagcgcccattgagaaaacaatctcaaaagcgaaaggccaaccgagagaacctcaagtctatactcttccccgtcgagagaggaaa
tgaccaaaaaccaggtatccctgtcatgcgcggtcaaggggtttacccaagcgacatcgccgtggagtgggagtcgaacggacagccagagaataac
tataagacgacccctcccgtgctggattcggatggatcgttctttcttgtcagcaaactcacagtcgacaaatcaaggtggcagcaagggaacgtgtt
cagctgttcggtaatgcatgaagccctccacaatcactacacgcagaaatccctgtcgctctcaccagggaagactagacccgctccaccctcaaccg
cgacaacagccggctcgacgcctcagcccgaatcggcctcaccgtcgggcaaagagcctgcggcatcgtcgccctcgtcaaccaatacaggctcatgt
ccgccgtgccctgcccccgaattgctgggaggtccgtccgtatttctgtttcccccgaagcctaaagatactcttatgatctcgcgaacgccggaagt
aacttgtgtcgtggtagatgtctcacacgaagatcccgaagtgaaattcaattggtatgtcgacggcgtggaggtacataacgccaagacgaagccta
gagaggaacagtaccagtcaacgtatcgggtcgtatccgtgctcaccgtgctccaccaggattggctgaacggaaaggagtacaagtgcaaagtctcg
aacaaggcgttgcctgcgccaatcgaaaagacgatctccaaagctaagggacaaccaagggaaccacaagtgtatactctcccgccctcgcgcgaaga
gatgacaaagaatcaggtgtcactttggtgcttggtgaaggggttctatccctcggatattgcggtcgagtgggagagcaatggtcaaccggagaaca
attacaagacgacaccgcccgtattggactccgacgggtccttctttctctactcgaagctcactgtagataagtcgcgatggcagcaggggaacgtc
tttagctgttccgtgatgcacgaggcacttcataaccactatacccagaagtcgttgtcgctttcccccggaaaaggaggtggagggagcggtggtgg
gggatcccaagtccagttgcaagaaagcgggccaggactcgtgaaaccctcggaaaccctgtcactgacgtgcacggtgagcggagggtccgtgtcga
gcggagattactattggacttggattagacagtcgcccggaaaaggtctggagtggatcggacacatctactactcggggaatacgaattacaacccg
tcgttgaaatcacggctcacgattagcatcgatacctccaagacgcagttctcgctcaaacttagctccgtaactgcggccgacaccgcaatctacta
ttgtgtacgcgaccgcgtcacaggggcttttgacatttggggtcagggcactatggtgacctcgtcagcgtcgacaggtggtggggggatcaggaggag
gtggctccgggggaggcggaagcggcggtgggggctccgacatccagatgacgcagtcgccctcatcattgtcagcatcagtcggggacagggtcact
attacttgtcaggccagccaagatatctcgaactatctgaactggtatcagcagaagcctggaaaagcgcctaagctccttatctatgatgcgtccaa
tcttgagacaggggtgccgtcgcggttttccggttcagggtcgggaacggacttcacgtttacaatctccagcctgcagccggaggacgaagccacct
acttctgccaacacttcgaccatttgcctcttgcgttcggaggtgggacaaaggtggagatcaagcgaact

*Fig. 10*
(Cont'd)

SEQ ID NO:348 (encodes SEQ ID NO:349):
gaggtgcaactggtagaaagcggaggtggtcttgtacagcccggtggttcactcagactgtcgtgcgcagcttcagggtatacgttcacctcctactg
gctccattgggtgcgacaggctccggggaaaggactggaatgggtcgggatgattgatccgtcgaattcggatactaggttcaatcccaacttcaagg
accggtttaccattagcgcggatacctcgaaaaacaccgcatatctccaaatgaactcgttgagagccgaggacacggcggtgtattactgcgcaaga
tacgggtcgtatgtgtcaccgttggactactggggccaggggacactggtaacggtcagctcagctagcacgaagggacctagcgtgttcccattggc
gcccagctcgaaatccacatcgggcggaacggcagcccttgggtgcctcgtgaaagactactttcccgaaccggtgactgtgtcgtggaattcagggg
cattgacttccggtgtccacacatttccagccgtgctgcagtccagcgggttgtattcgctctcgtcagtggtcacagtcccatcctcctcgctcgga
acacaaacctatatctgtaatgtcaaccataaaccttcaaatacaaaagtggacaaaaaggtagaaccgaaatcatgcgacaagacccatacatgccc
aagctgtcccgctccggagtttctcggtggaccgtcggtgtttctgttccctccgaagccaaaagataccttgatgatttcgcgaactcccgaagtca
cgtgtgtcgtcgtggacgtaagccaggaggacccggaggtccagttcaattggtatgtagacggcgtagaggtacataatgcgaaaacgaagcccaga
gaggaacagttcaatagcaaataccgcgtagtatcggtgctgacagtgttgcaccaggactggctgaatggaaaagaatacaagtgtaaagtgtccaa
caagggccttccatcgtcgattgaaaagacaatctccaaggcaaaggggcagcctagggagccccaagtctacaccctgccccttcgcgggaggaga
tgacgaagaaccaggtatcactgtcatgcgcggtcaaaggatttacccgagcgacatcgccgtagaatgggagtccaacggacagccagaaaacaat
tacaagaccactcctccagtgctcgatagcgatggctccttctttcttgtcagcaaattgacagtcgataagtcaagatggcagcagggtaatgtgtt
ctcatgtagcgtcatgcacgaagcactccacaatcattatacacagaagagcctctcgttgtcgcccggaaaaactagacccgctccaccctcaaccg
cgacaacagccggctcgacgcctcagcccgaatcggcctcaccgtcgggcaaagagcctgcggcatcgtcgccctcgtcaaccaatacaggctcatgc
ccttcatgtccagcccccgagttcctcggaggcccgtcggtctttctttttcccccctaagcctaaagataccctgatgatcagccggacgcctgaggt
gacttgtgtggtagtcgacgtgtcccaagaagatccggaagtccagtttaactggtatgtggatggagtggaggtccataatgccaagacaaagccaa
gggaggagcaattcaactcgaagtaccgcgtcgtgtccgtgctcacagtgcttcatcaagactggttgaacggaaaggagtacaaatgtaaggtatca
aacaagggtttgccctcgtccatcgagaaaaccatctcgaaagcgaaagggcaaccccgcgagccccaggtatatacgctcccgccttcaagagaaga
aatgacgaaaaaccaagtgagcttgtggtgcctggtcaaggggttctatccctccgatatcgcggtagagtgggaaagcaatgggcagccggagaaca
actataagacaacgcctcccgtgttggactcagatggatcgttcttcttgtactcaaagcttacggtggacaagtcacgctggcagcaagggaacgtg
ttttcgtgctcggtgatgcacgaggcgcttcacaatcactacactcagaaatcgcttagcttgtcaccaggaaaaggaggtggagggagcggtggtgg
gggatcccaagtccagttgcaagaaagcgggccaggactcgtgaaaccctcggaaaccctgtcactgacgtgcacggtgagcggagggtccgtgtcga
gcggagattactattggacttggattagacagtcgcccggaaaaggtctggagtggatcggacacatctactactcggggaatacgaattacaacccg
tcgttgaaatcacggctcacgattagcatcgatacctccaagacgcagttctcgctcaaacttagctccgtaactgcggccgacaccgcaatctacta
ttgtgtacgcgaccgcgtcacaggggcttttgacatttggggtcagggcactatggtgacctcgtcagcgtcgacaggtggtggggggatcaggaggag
gtggctccgggggaggcggaagcggcggtgggggctccgacatccagatgacgcagtcgccctcatcattgtcagcatcagtcggggacagggtcact
attacttgtcaggccagccaagatatctcgaactatctgaactggtatcagcagaagcctggaaaagcgcctaagctccttatctatgatgcgtccaa
tcttgagacaggggtgccgtcgcggttttccggttcagggtcggaacggacttcacgtttacaatctccagcctgcagccggaggacgaagccacct
acttctgccaacacttcgaccatttgcctcttgcgttcggaggtgggacaaaggtggagatcaagcgaact Fig. 10
(Cont'd)

23: T366S/L368A/Y407V::T366W

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKPKDTLMISRTPEVT
CVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:293)

atgggcttcggactgtcgtggctttttctggtggcgattcttaaggggtccagtgcgataagacccacacatgccctccctgtccagcacccgagctgctcggggg
accctcggtgttcttgtttcctcccaaacccaaagatacccttatgattagccggacaccagaggtgacgtgcgtggtagtagacgtgtcccatgaggacccggagg
tcaagttcaactggtacgtggacggagtggaggtgcacaatgcaaagaccaagccgagggaagagcaataccagtccacatatagagtcgtgtcggtccttacggtc
ttgcatcaggactggctgaatggcaaagaatacaaatgtaaagtctccaacaaagctctcccagcgcccattgagaaaacaatctcaaaagcgaaaggccaaccgag
agaacctcaagtctatactcttcccccgtcgagagaggaaatgaccaaaaaccaggtatccctgtcatgcgcggtcaaggggtttacccaagcgacatcgccgtgg
agtgggagtcgaacggacagccagagaataactataagacgacccctcccgtgctggattcggatggatcgttctttcttgtcagcaaactcacagtcgacaaatca
aggtggcagcaagggaacgtgttcagctgttcggtaatgcatgaagccctccacaatcactacacgcagaaatccctgtcgctctcaccaggaaggtgggggtgg
ctcaggggggtggggatcaggtggtggtggtagcggaggtggagggagcggaggcggaggctccggtggaggaggttccggaggtggcgggtcaggggaggagggt
catgtccgccgtgccctgcccccgaattgctgggaggtccgtccgtatttctgtttcccccgaagcctaaagatactcttatgatctcgcgaacgccggaagtaact
tgtgtcgtggtagatgtctcacacgaagatcccgaagtgaaattcaattggtatgtcgacggcgtggaggtacataacgccaagacgaagcctagagaggaacagta
ccagtcaacgtatcgggtcgtatccgtgctcaccgtgctccaccaggattggctgaacggaaaggagtacaagtgcaaagtctcgaacaaggcgttgcctgcgccaa
tcgaaaagacgatctccaaagctaagggacaaccaaggaaccacaagtgtatactctcccgccctcgcgcgaagagatgacaaagaatcaggtgtcactttggtgc
ttggtgaaggggttctatccctcggatattgcggtcgagtgggagagcaatggtcaaccggagaacaattacaagacgacaccgcccgtattggactccgacgggtc
cttctttctctactcgaagctcactgtagataagtcgcgatggcagcaggggaacgtctttagctgttccgtgatgcacgaggcacttcataaccactatacccaga
agtcgttgtcgctttcccccggaaaatgataa
(SEQ ID NO:292)

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKPKDTLMISRTPEVT
CVVVDVSHEDPEVKFNWYVDGVEVHNAKTKPREEQYQSTYRVVSVLTVLHQDWLNGKEYKCKVSNKALPAPIEKTISKAKGQPREPQVCTLPPCREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:295)

atgggcttcggactgtcgtggctttttctggtggcgattcttaaggggtccagtgcgataaaactcacacgtgccctccatgccctgctccggaacttctcggggg
accgtccgtattcctctttcctcctaagcctaaggacaccctcatgatcagcaggacccccgaggtgacgtgtgtagtcgtggatgtgtcccacgaggacccggaag
tcaagttcaactggtatgtagatggagtggaggtccataatgccaagaccaagccaagagaggagcagtatcagtcgacttatcgggtggtcagcgtcctcacggta
cttcatcaggattggctgaatggaaaggagtacaaatgtaaggtatccaacaaagcgttgccagcgcccatcgaaaagacaatctcgaaggcgaagggacaaccccg
ggaaccgcaagtgtgtaccctgccaccttcccgggaggagatgacgaaaaaccaggtatccctgtcgtgcgccgtgaaagggttttacccatcggatatcgcagtgg
agtgggaaagcaatgggcagccggaaaacaactataagaccacgccccctgtactcgactcggatgggtcctttttcctcgtcagcaaacttacggtagacaaaagc
aggtggcaacaggggaatgtgttcagctgctcagtcatgcacgaggcactccataaccattacactcagaaatcactgtcgctgtcgcccggtaaaggggaggtgg
gtcgggcggtgggggaagcggtggtgggggatcaggtgggggaggttcgggaggtggtgggagcggtggaggcggttccggaggaggcgggtcgggtggaggtggat
cgtgcccaccgtgccccgcaccggaactccttggggaccatccgtgtttctgtttccaccgaagccaaaggacactctcatgatctcgcgcacaccagaggtgaca
tgtgtcgtcgtcgatgtgtcacacgaagatccagaggtcaagtttaactggtacgtggacggagtcgaggtccacaatgcgaaaacgaaacccagagaagagcagta
ccagtcaacataccgggtggtgagcgtattgaccgtgcttcaccaggactggcttaacgggaaagagtacaagtgtaaggtcagcaataaggcgctcccagcgccta
ttgagaaaactatctcgaaagcaaaggggcagccacgagagccccaagtgtgtacgctgccaccctgtcgggaggaaatgaccaagaatcaagtctcgctttggtgc
cttgtgaagggattctatcccagcgacattgctgtagagtgggagtcgaacgggcaacccgagaataactacaagactactccgccggtgttggactcggacgggtc
gttcttcctttatagcaaactcacagtcgacaagtccagatggcagcagggaaatgtcttttcctgctcggtaatgcacgaagcgttgcataaccactatacacaga
agtcgctttcgttgtcacccgggaaatgataa
(SEQ ID NO:294)

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLTVDKS
RWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKPKDTLMISRTPEVT
CVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLYC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:297)

atgggcttcggactgtcgtggctttttctggtggcgattcttaaggggtccagtgcgacaaaacgcacacttgtccgccgtgccctgccccagagttgcttggagg
accatcagtatttctcttccctcctaagccgaaagacacactcatgatctcacgcacaccggaagtaacttgcgtggtggtggatgtgtcgcatgaagatcccgagg
tcaaattcaactggtacgtcgacggtgtggaggtgcacaacgccaagacgaaacccagagaagagcagtatcagtcgacctaccgagtggtatccgtgcttacggtg
ctgcatcaggattggttgaatggaaaagaatacaaatgcaaagtctcgaataaggcgctcccagccccaatcgaaaagacgatttccaaggcgaagggcagcctcg
ggaacctcaggtctatacccttcctccgtcacgcgaggaaatgacaaagaatcaggtcagcctcacatgcctcgtgaagggattctatccgtcggatattgctgtcg
agtgggaatcgaacggacagcccgagaacaattacaaaacaactcctcccgtacttgactcggacgggagctttttccttacgtcaaagctgaccgtcgataaaagc
aggtggcagcaagggaatgtgttttcgtgctcggtcatgcacgaagcacttcataaccactacacccagaaatccttgagcctgtcaccggggaagggaggaggggg
tagcggcggtggagggagcggaggaggcgggtccggtgggggtgggtccgggggtggcggaagcggtggcggaggttcgggaggggggaggaagcggagggggtggat
cgtgtcctccgtgcccagcccccgaactcctcggggggaccctcggtattcctttttccgccgaaacccaaggacactttgatgattagccggacgcccgaggtgaca
tgcgtggtcgtggatgtatcgcatgaggaccccgaagtgaagttcaattggtacgtggatggggtggaagtccataacgcaaagaccaagcccagagaggagcagta
ccaatcgacgtatagggtcgtgtccgtcctcacagtcttgcaccaggactggttgaacgggaaggagtataagtgtaaggtcagcaacaaagcgttgcctgcgccca
ttgaaaagactatctcaaaagcaaagggacagcccagggagccccaagtgtacacactgcccccgtcaagagaagaaatgaccaaaaatcaagtgtccctctactgc
ttggtgaaggggttctatcccagcgacatcgcggtagagtgggagtcaaatggccagcccgaaaacaactacaaaacgacaccgcccgtgttggattcggatgggtc
attctttctgtattcaaaactgacagtggacaagtcgcggtggcaacaggggaacgtgttttcctgttccgtaatgcacgaggcgttgcacaatcactatacgcaga
agtccctctcgctttcacccgggaagtgataa
(SEQ ID NO:296)

MGFGLSWLFLVAILKGVQCDKTCCCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKPKDTLMISRTPEVT
CVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:299)

atgggcttcggactgtcgtggctttttctggtggcgattcttaaggggtccagtgcgataagacttgctgctgtcctccctgtccagcacccgagctgctcggggg
accctcggtgttcttgtttcctcccaaacccaaagataccccttatgattagccggacaccagaggtgacgtgcgtggtagtagacgtgtcccatgaggacccggagg
tcaagttcaactggtacgtggacggagtggaggtgcacaatgcaaagaccaagccgagggaagagcaataccagtccacatatagagtcgtgtcggtccttacggtc
ttgcatcaggactggctgaatggcaaagaatacaaatgtaaagtctccaacaaagctctcccagcgcccattgagaaaacaatctcaaaagcgaaaggccaaccgag
agaacctcaagtctatactcttccccgtcgagagaggaaatgaccaaaaatcaggtatccctgtcatgcgcggtcaaggggttttacccaagcgacatcgccgtgg
agtgggagtcgaacggacagccagagaataactataagacgacccctcccgtgctggattcggatggatcgttctttcttgtcagcaaactcacagtcgacaaatca
aggtggcagcaagggaacgtgttcagctgttcggtaatgcatgaagccctccacaatcactacacgcagaaatccctgtcgctctcaccagggaagggtggggtgg
ctcagggggtgggggatcaggtggtggtggtagcggaggtggagggagcggaggcggaggctccggtggaggaggttccggaggtggcgggtcagggggaggagggt
catgtccgccgtgccctgcccccgaattgctgggaggtccgtccgtatttctgtttcccccgaagcctaaagatactcttatgatctcgcgaacgccggaagtaact
tgtgtcgtggtagatgtctcacacgaagatcccgaagtgaaattcaattggtatgtcgacggcgtggaggtacataacgccaagacgaagcctagagaggaacagta
ccagtcaacgtatcgggtcgtatccgtgctcaccgtgctccaccaggattggctgaacggaaaggagtacaagtgcaaagtctcgaacaaggcgttgcctgcgccaa
tcgaaaagacgatctccaaagctaagggacaaccaagggaaccacaagtgtatactctcccgccctcgcgcgaagagatgacaaagaatcaggtgtcactttggtgc
ttggtgaaggggttctatccctcggatattgcggtcgagtgggagagcaatggtcaaccggagaacaattacaagacgacaccgcccgtattggactccgacgggtc
cttctttctctactcgaagctcactgtagataagtcgcgatggcagcaggggaacgtctttagctgttccgtgatgcacgaggcacttcataaccactatacccaga
agtcgttgtcgctttcccccggaaaatgataa
(SEQ ID NO:298)

MGFGLSWLFLVAILKGVQCDKCHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*CPPCPAPELLGGPSVFLFPPKPKDTLMISRTPEVT
CVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:301)

atgggcttcggactgtcgtggctttttctggtggcgattcttaaggggtccagtgcgataagtgccacacatgccctccctgtccagcacccgagctgctcggggg
accctcggtgttcttgtttcctcccaaacccaaagataccccttatgattagccggacaccagaggtgacgtgcgtggtagtagacgtgtcccatgaggacccggagg
tcaagttcaactggtacgtggacggagtggaggtgcacaatgcaaagaccaagccgagggaagagcaataccagtccacatatagagtcgtgtcggtccttacggtc
ttgcatcaggactggctgaatggcaaagaatacaaatgtaaagtctccaacaaagctctcccagcgcccattgagaaaacaatctcaaaagcgaaaggccaaccgag
agaacctcaagtctatactcttccccgtcgagagaggaaatgaccaaaaaccaggtatccctgtcatgcgcggtcaaggggttttacccaagcgacatcgccgtgg
agtgggagtcgaacggacagccagagaataactataagacgacccctcccgtgctggattcggatggatcgttctttcttgtcagcaaactcacagtcgacaaatca
aggtggcagcaagggaacgtgttcagctgttcggtaatgcatgaagccctccacaatcactacacgcagaaatccctgtcgctctcaccagggaagggtgggggtgg
ctcaggggggtgggggatcaggtggtggtggtagcggaggtggagggagcggaggcggaggctccggtggaggaggttccggaggtggcgggtcaggggggaggagggt
catgtccgccgtgccctgcccccgaattgctgggaggtccgtccgtatttctgtttcccccgaagcctaaagatactcttatgatctcgcgaacgccggaagtaact
tgtgtcgtggtagatgtctcacacgaagatcccgaagtgaaattcaattggtatgtcgacggcgtggaggtacataacgccaagacgaagcctagagaggaacagta
ccagtcaacgtatcgggtcgtatccgtgctcaccgtgctccaccaggattggctgaacggaaaggagtacaagtgcaaagtctcgaacaaggcgttgcctgcgccaa
tcgaaaagacgatctccaaagctaagggacaaccaagggaaccacaagtgtatactctcccgccctcgcgcgaagagatgacaaagaatcaggtgtcactttggtgc
ttggtgaaggggttctatccctcggatattgcggtcgagtgggagagcaatggtcaaccggagaacaattacaagacgacaccgcccgtattggactccgacgggtc
cttctttctctactcgaagctcactgtagataagtcgcgatggcagcaggggaacgtctttagctgttccgtgatgcacgaggcacttcataaccactatacccaga
agtcgttgtcgctttcccccggaaaatgataa
(SEQ ID NO:300)

*Fig. 11*
(Cont'd)

23E: T366S/L368A/Y407V/CH3 C-terminal Cysteine KSCDKT::T366W/CH3 C-terminal Cysteine GEC MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFPPKPKDTLMISRTP
EVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVS
LWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:303)

atgggcttcggactgtcgtggctttttctggtggcgattcttaaggggtccagtgcgataaaacacacacatgcccaccatgcccagcgcctgaacttttgggagg
tccctcggtgtttttgtttcctcctaagcctaaggacaccctgatgatctcccgcactccggaagtgacgtgtgtcgtagtcgacgtcagccatgaggaccctgagg
tgaaattcaactggtacgtagatggtgtggaggtgcataatgcaaaaactaagcctcgggaggaacaatatcaaagcacataccgggtcgtgtccgtgctcacggta
cttcatcaggattggctcaacgggaaagaatacaaatgtaaggtgtccaacaaggctctcccggcaccgattgagaaaacgatcagcaaggccaaggggcagccccg
agaaccccaagtatacacacttcccccgtccagggaggagatgaccaagaaccaggtgtcgctgtcgtgtgcggtcaaggggttttatcccagcgacatcgcggtag
agtgggagtcgaacggccagcccgagaacaactacaagacaacaccgcctgtattggactcggacgggtcgtttttcctggtcagcaagctcacagtggataaaagc
cgctggcagcaggggaatgtattctcctgctccgtcatgcacgaggcgcttcacaaccattacacgcaaaaatccctgtccttgtccaagtcatgcgacaagacggg
aggaggagggtcaggcggaggaggaagcgggggtggagggtccggtggtggtgggagcggaggtggagggagcggtggaggtggtagcgggggaggtggatcgggag
gggtgggagctgtccgccatgtccagccccggaacttctcggggggaccgtcagtctttcttttttccgccgaagcccaaggacaccttgatgattagccgcacgccg
gaggtcacgtgcgtagtagtggatgtatcccacgaggaccccgaggtcaaattcaattggtatgtcgacggagtggaagtacacaacgcaaagacaaagccgagaga
agagcagtaccaatccacttatagggtagtctcggtcttgacagtactgcaccaggactggcttaatggaaaggaatacaagtgcaaagtctcaaacaaagccctcc
ccgcacccatcgaaaagacaatctcgaaagcgaaaggacagcccagagagcctcaagtgtataccctgcccccgtcaagagaagagatgacgaagaaccaagtgtcc
ctctggtgtctcgtgaaaggttttaccccagcgatattgccgtcgaatgggaaagcaatggtcagcccgaaaacaattacaagactacgcctcccgtattggattc
ggatggttcgttcttcttgtactcaaagcttactgtcgataagtcgcggtggcagcaaggcaatgtgtttagctgttcggtaatgcatgaggcgctccacaatcact
atacacagaagagcttgtccctcagcggggagtgctgataa
(SEQ ID NO:302)

*Fig. 11*
(Cont'd)

23G: T366S/L368A/Y407V::T366W and (G4S)4

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGS*CPPCPAPELLGGPSVFLFPPKPKDTLMISRTPEVTCVVVDVSHEDPEVKFNWYVD
GVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQP
ENNYKTTPPVLDSDGSFFLYSKLTVDKSRWQQGNVFSCSVMHEALHNHYTQKSLSLSPGK
(SEQ ID NO:305)

atgggcttcggactgtcgtggctttttctggtggcgattcttaaggggtccagtgcgacaagacccacacctgcccaccgtgtccagcgcccgagctcctcggagg
gccgtcggtgttcctctttcccccaaagcctaaagacactctgatgatcagccgcactccagaagtgacatgtgtggtggtggatgtctcgcatgaggacccggaag
tcaaattcaattggtacgtggatggtgtcgaagtgcacaacgccaagacaaaaccgcgcgaggagcagtaccagagcacctaccgggtggtatcagtgcttacagta
ctgcatcaggattggctgaacggaaaggagtacaagtgtaaagtcagcaacaaagcgctcccggctccgatcgagaaaacgatctcaaaggccaagggccagccgcg
agaaccccaagtatacacgttgcccccttcaagggaggaaatgaccaagaatcaggtgtcactgagctgcgccgtcaagggattctacccctcggacattgcagtag
agtgggagtcgaatgggcaacccgaaaacaactataagacgacacccccggtcctcgactcagatggatcgttcttccttgtatcaaaattgacggtcgacaagagc
cggtggcagcaaggtaacgtatttcgtgttcggtgatgcatgaagcgctgcataaccactatacgcagaagagcttgtccttgtcaccaggcaagggaggtggggg
ttcgggcggaggaggtagcggcggagggggtagcggaggtggcgggtcctgtcccccgtgccccgcaccggagctgctgggaggtccgtcagtgtttttgtttcctc
ccaagccgaaagacacgctgatgatctcgaggacgcccgaggtaacgtgcgtcgtcgtcgatgtatcccacgaagatcccgaggtcaagttcaactggtatgtagat
ggggtcgaagtccataacgctaagacaaagccgagagaggaacaatatcagtcaacttatcgggtcgtgtcggtcctgaccgtacttcaccaggactggctcaatgg
gaaagagtacaaatgcaaggtgtccaataaggcgctgcctgcgccaattgagaaaactatctcgaaagcgaagggacagcccagagagccgcaagtatatacactgc
caccctcgagagaagaaatgacgaagaatcaagtctccttgtggtgtttggtgaaggggttttacccttcagacatcgcagtggaatgggaatcgaacgggcagcca
gaaaacaattacaaaaccacacctcctgtccttgactccgatggctcatttttcctctattcgaagctcactgtcgacaagtcgcgctggcagcagggtaacgtctt
tagctgctccgtgatgcacgaggccctccacaatcattatacacagaaatcgctgtcactttcgcccggaaaatgataa
(SEQ ID NO:304)

Fig. 11
(Cont'd)

23E (35L): T366S/L368A/Y407V/CH3 C-terminal Cysteine KSCDKT::T366W/CH3 C-terminal Cysteine GEC and (G4S)7

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGSGGGGS*CPPCPAPELLGGPSVFLFPPKPKDTLMISRTPEVTCV
VVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLV
KGFYPSDIAVEWESNGQPENNYKTTPPVLDSDGSFFLYSKLTVDKSRWQQGNVFSCSVMHEALHNHYTQKSLSLSGEC
(SEQ ID NO:307)

atgggcttcggactgtcgtggctttttctggtggcgattcttaagggggtccagtgcgacaaaacgcacacctgtccgccctgtcctgccccggaacttctcggagg
gccttccgtgtttctcttccctccgaagcccaaggacacgctgatgatctcccggaccccggaggtcacgtgtgtggtagtagacgtgtcacacgaagatccggagg
tgaagttcaactggtacgtagatggcgtggaggtgcacaacgccaaaacgaagccccgagaggaacagtaccagtcaacgtaccgcgtcgtgtcggtattgactgta
ttgcatcaagactggttgaacgggaaggagtataagtgtaaagtcagcaacaaggctcttcccgcacccattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgagcaaatcatgcgacaagaccgg
gggtggtgggagcggcggaggaggtagcggcggaggtggctcgggaggaggtgggtcgggtggtggggaagcggaggcggagggagcggaggtggtgggtcatgtc
cgccgtgcccggcacccgaactgctcggaggtccctcggtgttcctgttcccgccaaagcctaaggatacgttgatgatttcgcgcacgccggaggtaacatgcgtg
gtggtggatgtgtcacatgaggaccccgaggtcaagttcaattggtacgtcgatggagtggaagtgcacaatgcgaaaacaaaaccccgggaggagcagtatcagag
cacgtacagggtagtctccgtcctgactgtacttcaccaagactggcttaacggaaaagagtataagtgcaaggtcagcaacaaggcgcttcctgcccctatcgaga
aaaccatctcgaaggccaagggacagccgagggagcctcaagtatacacgctgccgccatcgagagaagaaatgaccaaaaaccaggtgtccctttggtgtttggtg
aagggtttctatccctccgatatcgccgtagagtgggagtcaaatggacagcctgagaacaactataagactacgccccctgtgttggacagcgatgggtcattctt
tctgtattcgaaactcacggtggataagtcgcgatggcaacagggcaatgtgttttcgtgcagcgtgatgcatgaggcgctgcacaaccactatactcagaaatcgt
taagcttatcgggagagtgttgataa
(SEQ ID NO:306)

*Fig. 11*
(Cont'd)

23E (35L) Inverted: T366S/L368A/Y407V/CH3 C-terminal Cysteine GEC::T366W/CH3 C-terminal Cysteine KSCDKT and (G4S)7

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSGEC*GGGGSGGGGSGGGGSGGGGSGGGGSGGGGSGGGGS*CPPCPAPELLGGPSVFLFPPKPKDTLMISRTPEVTCVVVD
VSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGF
YPSDIAVEWESNGQPENNYKTTPPVLDSDGSFFLYSKLTVDKSRWQQGNVFSCSVMHEALHNHYTQKSLSLSKSCDKT
(SEQ ID NO:309)

atgggcttcggactgtcgtggctttttctggtggcgattcttaaggggtccagtgcgacaaaacgcacacctgtccgccctgtcctgccccggaacttctcggagg
gccttccgtgtttctcttccctccgaagcccaaggacacgctgatgatctcccggaccccggaggtcacgtgtgtggtagtagacgtgtcacacgaagatccggagg
tgaagttcaactggtacgtagatggcgtggaggtgcacaacgccaaaacgaagccccgagaggaacagtaccagtcaacgtaccgcgtcgtgtcggtattgactgta
ttgcatcaagactggttgaacgggaaggagtataagtgtaaagtcagcaacaaggctcttcccgcacccattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgagcggggaatgcggagggggagg
gtccgggggtggtgggagcggcggaggaggtagcggcggaggtggctcgggaggaggtgggtcgggtggtgggggaagcggaggcggagggtcatgtccgccgtgcc
cggcacccgaactgctcggaggtccctcggtgttcctgttcccgccaaagcctaaggatacgttgatgatttcgcgcacgccggaggtaacatgcgtggtggtggat
gtgtcacatgaggaccccgaggtcaagttcaattggtacgtcgatggagtggaagtgcacaatgcgaaaacaaaaccccgggaggagcagtatcagagcacgtacag
ggtagtctccgtcctgactgtacttcaccaagactggcttaacggaaaagagtataagtgcaaggtcagcaacaaggcgcttcctgcccctatcgagaaaaccatct
cgaaggccaagggacagccgagggagcctcaagtatacacgctgccgccatcgagagaagaaatgaccaaaaaccaggtgtccctttggtgtttggtgaagggtttc
tatccctccgatatcgccgtagagtgggagtcaaatggacagcctgagaacaactataagactacgcccccctgtgttggacagcgatgggtcattctttctgtattc
gaaactcacggtggataagtcgcgatggcaacagggcaatgtgttttcgtgcagcgtgatgcatgaggcgctgcacaaccactatactcagaaatcgttaagcttat
cgaagtcatgcgacaagacttgataa
(SEQ ID NO:308)

*Fig. 11*
(Cont'd)

23E (30L): T366S/L368A/Y407V/CH3 C-terminal Cysteine KSCDKT::T366W/CH3 C-terminal Cysteine GEC and (G4S)6

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGS*CPPCPAPELLGGPSVFLFPPKPKDTLMISRTPEVTCVVVDVS
HEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLSGEC
(SEQ ID NO:311)

atgggcttcggactgtcgtggctttttctggtggcgattcttaaggggtccagtgcgacaaaacgcacacctgtccgccctgtcctgccccggaacttctcggagg
gccttccgtgtttctcttccctccgaagcccaaggacacgctgatgatctcccggaccccggaggtcacgtgtgtggtagtagacgtgtcacacgaagatccggagg
tgaagttcaactggtacgtagatggcgtggaggtgcacaacgccaaaacgaagccccgagaggaacagtaccagtcaacgtaccgcgtcgtgtcggtattgactgta
ttgcatcaagactggttgaacgggaaggagtataagtgtaaagtcagcaacaaggctcttcccgcacccattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgagcaaatcatgcgacaagaccgg
gggtggtgggagcggcggaggaggtagcggcggaggtggctcgggaggaggtgggtcgggtggtgggggaagcggaggcggagggtcatgtccgccgtgcccggcac
ccgaactgctcggaggtccctcggtgttcctgttcccgccaaagcctaaggatacgttgatgatttcgcgcacgccggaggtaacatgcgtggtggtggatgtgtca
catgaggaccccgaggtcaagttcaattggtacgtcgatggagtggaagtgcacaatgcgaaaacaaaaccccgggaggagcagtatcagagcacgtacagggtagt
ctccgtcctgactgtacttcaccaagactggcttaacggaaaagagtataagtgcaaggtcagcaacaaggcgcttcctgcccctatcgagaaaaccatctcgaagg
ccaagggacagccgagggagcctcaagtatacacgctgccgccatcgagagaagaaatgaccaaaaaccaggtgtccctttggtgtttggtgaagggtttctatccc
tccgatatcgccgtagagtgggagtcaaatggacagcctgagaacaactataagactacgcccccctgtgttggacagcgatgggtcattctttctgtattcgaaact
cacggtggataagtcgcgatggcaacagggcaatgtgttttcgtgcagcgtgatgcatgaggcgctgcacaaccactatactcagaaatcgttaagcttatcgggag
agtgttgataa
(SEQ ID NO:310)

Fig. 11
(Cont'd)

23E (25L): T366S/L368A/Y407V/CH3 C-terminal Cysteine KSCDKT:: T366W/CH3 C-terminal Cysteine GEC and (G4S)5

MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGS*CPPCPAPELLGGPSVFLFPPKPKDTLMISRTPEVTCVVVDVSHEDPE
VKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAV
EWESNGQPENNYKTTPPVLDSDGSFFLYSKLTVDKSRWQQGNVFSCSVMHEALHNHYTQKSLSLSGEC
(SEQ ID NO:313)

atgggcttcggactgtcgtggctttttctggtggcgattcttaaggggtccagtgcgacaaaacgcacacctgtccgccctgtcctgccccggaacttctcggagg
gccttccgtgtttctcttccctccgaagcccaaggacacgctgatgatctcccggaccccggaggtcacgtgtgtggtagtagacgtgtcacacgaagatccggagg
tgaagttcaactggtacgtagatggcgtggaggtgcacaacgccaaaacgaagccccgagaggaacagtaccagtcaacgtaccgcgtcgtgtcggtattgactgta
ttgcatcaagactggttgaacgggaaggagtataagtgtaaagtcagcaacaaggctcttcccgcacccattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgagcaaatcatgcgacaagaccgg
gggtggtgggagcggcggaggaggtagcggcggaggtggctcgggaggaggtgggtcgggtggtgggggatcatgtccgccgtgcccggcacccgaactgctcggag
gtccctcggtgttcctgttcccgccaaagcctaaggatacgttgatgatttcgcgcacgccggaggtaacatgcgtggtggtggatgtgtcacatgaggaccccgag
gtcaagttcaattggtacgtcgatggagtggaagtgcacaatgcgaaaacaaaaccccgggaggagcagtatcagagcacgtacagggtagtctccgtcctgactgt
acttcaccaagactggcttaacggaaaagagtataagtgcaaggtcagcaacaaggcgcttcctgcccctatcgagaaaaccatctcgaaggccaagggacagccga
gggagcctcaagtatacacgctgccgccatcgagagaagaaatgaccaaaaaccaggtgtccctttggtgtttggtgaagggtttctatccctccgatatcgccgta
gagtgggagtcaaatggacagcctgagaacaactataagactacgccccctgtgttggacagcgatgggtcattctttctgtattcgaaactcacggtggataagtc
gcgatggcaacagggcaatgtgttttcgtgcagcgtgatgcatgaggcgctgcacaaccactatactcagaaatcgttaagcttatcgggagagtgttgataa
(SEQ ID NO:312)

*Fig. 11*
(Cont'd)

23I: S364H/F405A::Y349T/T394F with CH3 terminal disulfide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVHLTCLVKGFYPSDIAVEWESNGQPENNYKTTPPVLDSDGSFALYSKLTVDKS
RWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFPPKPKDTLMISRTP
EVTCVVVDVSHEDPEVKFNWYVDGVEVHNAKTKPREEQYQSTYRVVSVLTVLHQDWLNGKEYKCKVSNKALPAPIEKTISKAKGQPREPQVTTLPPSREEMTKNQVS
LTCLVKGFYPSDIAVEWESNGQPENNYKTFPPVLDSDGSFFLYSKLTVDKSRWQQGNVFSCSVMHEALHNHYTQKSLSLSGEC
(SEQ ID NO:315)

atgggcttcggactgtcgtggctttttctggtggcgattcttaaggggtccagtgcgacaaaacgcacacttgtccgccctgccctgcgcccgaactgcttggagg
cccttcggtgtttttgtttccgcccaagcctaaggacaccttgatgatcagccggacaccggaggtcacatgtgtcgtcgtggatgtctcgcacgaggatcccgagg
tcaagtttaactggtatgtggatggagtggaggtccacaacgccaaaaccaagcccagggaggagcaataccagtcaacctatcgggtagtctcggtgctgacggta
ctgcaccaggactggttgaatggaaaagagtacaaatgcaaggtatcaaacaaggcccttcccgctcccatcgaaaagacgatcagcaaagcgaaagggcaacccag
agagccccaagtctatacgctgcctccctcaagggaagaaatgacgaaaaaccaggtgcacttgacatgcctcgtgaaaggcttctacccgagcgacattgcggtgg
aatgggagtcaaatggtcagccggaaaacaactacaagacaactccaccggtccttgattcagacgggtcgttcgccctctatagcaaactcacggtcgacaagtcc
cgctggcagcagggtaacgtgttttcgtgttcagtgatgcacgaggctctgcataatcactacacacagaagtccctctccttgagcaaaagctgcgacaagacagg
gggtggaggttcaggcggtggtgggtcgggaggggagggtcaggtggaggcggcagcgggggtgggggatcgggaggaggagggtccgggggaggggggttccggag
ggggtgggtcctgtccccccttgtccagcgccggagctgttgggcggaccttcggtattcttgtttcctcctaagcccaaagatacgcttatgatctcccgcaccccg
gaggtaacttgcgtcgtagtggatgtatcacatgaggacccagaagtcaagttcaattggtacgtggacggagtcgaagtccataacgctaaaacgaaaccgagaga
ggaacagtatcagagcacctaccgggtagtgagcgtgctcacagtgttgcatcaggattggctgaatgggaaggaatacaagtgcaaagtgtcgaataaggcattgc
cagcaccgattgagaaaacaatctcaaaagcgaagggacagccccgagagcctcaagtcactacactgccacccagccgcgaagagatgacaaagaatcaggtatcc
ctcacgtgtcttgtgaaggggttctatccctccgatatcgcagtagagtgggaatcgaacgggcagccggagaacaattacaagactttcccgccagtgcttgattc
ggacggtagcttctttttgtattcgaagctcacggtagataagtcgaggtggcaacaaggaaatgtgttttcatgttcggtgatgcatgaagcgctccataaccact
atacgcagaaatcgctttcgctctccggtgaatgctgataa
(SEQ ID NO:314)

*Fig. 11*
(Cont'd)

23J: K370D/K392D/K409D::D356K/E357K/D399K with CH3 terminal disulfide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTV
LHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKS
RWQQGNVFSCSVMHEALHNHYTQKSLSLSKSCDKT*GGGGSGGGGSGGGGSGGGGSGGGGSGGGGSGGGGSGGGGS*CPPCPAPELLGGPSVFLFPPKPKDTLMISRTP
EVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRKKMTKNQVS
LTCLVKGFYPSDIAVEWESNGQPENNYKTTPPVLKSDGSFFLYSKLTVDKSRWQQGNVFSCSVMHEALHNHYTQKSLSLSGEC
(SEQ ID NO:317)

atgggcttcggactgtcgtggctttttctggtggcgattcttaaggggtccagtgcgacaaaacgcacacttgtccgccgtgcccagcgcccgagttgcttggcgg
acccagcgtgtttttgtttcccccgaaaccgaaagatacattgatgattagcagaacgcccgaagtgacgtgtgtagtagtcgacgtgtcgcacgaagatccggagg
tgaagttcaactggtatgtcgatggggtagaggtgcacaacgcgaaaaccaagcccagggaggagcagtaccagtcgacatatcgggtcgtgtcagtgctgacagtg
ctccatcaggactggttgaacgggaaggagtataagtgtaaagtcagcaacaaagccctccccgcacccatcgagaaaaccatttccaaggcaaagggacaaccgag
ggaaccacaagtctacactctcccaccctcccgcgaagaaatgacgaaaaaccaagtgtcactgacgtgtcttgtagatggtttctacccctcggacatcgcggtcg
aatgggagtcgaatggacagccggagaacaattacgataccacacctcctgtcttggattcggacggctcattcttcctttacagcgatctcactgtcgacaagtcg
cgctggcagcagggaaacgtcttttcctgttcggtaatgcacgaagctctgcacaatcactacacgcagaagtcgctttcactttccaaaagctgcgacaagacagg
gggtggaggttcaggcggtggtgggtcgggaggggggagggtcaggtggaggcggcagcgggggtgggggatcgggaggaggagggtccgggggaggggggttccggag
ggggtgggtcctgtccccccttgtccagcgccggagctgttgggcggaccttcggtattcttgtttcctcctaagcccaaagatacgcttatgatctcccgcaccccg
gaggtaacttgcgtcgtagtggatgtatcacatgaggacccagaagtcaagttcaattggtacgtggacggagtcgaagtccataacgctaaaacgaaaccgagaga
ggaacagtatcagagcacctaccgggtagtgagcgtgctcacagtgttgcatcaggattggctgaatgggaaggaatacaagtgcaaagtgtcgaataaggcattgc
cagcaccgattgagaaaacaatctcaaaagcgaagggacagccccgagagcctcaagtctatacactgccgccaagccggaagaagatgaccaaaaaccaggtgtcc
ctcacgtgcctcgtgaaagggttttacccgtcagatatcgccgtagaatgggagagcaatgggcagcccgagaataactataagactacgccccctgtactcaaatc
ggacgggtcattctttctgtattcgaagctcacggtagataagtcgaggtggcaacaaggaaatgtgttttcatgttcggtgatgcatgaagcgctccataaccact
atacgcagaaatcgctttcgctctccggtgaatgctgataa
(SEQ ID NO:316)

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*cpscpapeflggpsvflfppkpkdtlmisrtpevt
cvvvdvsqedpevqfnwyvdgvevhnaktkpreeqfnskyrvvsvltvlhqdwlngkeykckvsnkglpssiektiskakGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:319)

atgggcttcggactgtcgtggctttttctggtggcgattcttaaggggtccagtgcgacaagacccatacatgcccaagctgtcccgctccggagtttctcggtgg
accgtcggtgtttctgttccctccgaagccaaaagataccttgatgatttcgcgaactcccgaagtcacgtgtgtcgtcgtggacgtaagccaggaggacccggagg
tccagttcaattggtatgtagacggcgtagaggtacataatgcgaaaacgaagcccagagaggaacagttcaatagcaaataccgcgtagtatcggtgctgacagtg
ttgcaccaggactggctgaatggaaaagaatacaagtgtaaagtgtccaacaagggccttccatcgtcgattgaaaagacaatctccaaggcaaaggggcagcctag
ggagccccaagtctacaccctgccccttcgcgggaggagatgacgaagaaccaggtatcactgtcatgcgcggtcaaaggattttacccgagcgacatcgccgtag
aatgggagtccaacggacagccagaaaacaattacaagaccactcctccagtgctcgatagcgatggctccttctttcttgtcagcaaattgacagtcgataagtca
agatggcagcagggtaatgtgttctcatgtagcgtcatgcacgaagcactccacaatcattatacacagaagagcctctcgttgtcgcccggaaaaggcggaggtgg
gtcgggcggaggggaagcggtggaggagggtcaggaggtggaggttccgggggaggcggttcgggaggaggggggttcgggtggtggaggatcgggtggcggaggaa
gctgcccttcatgtccagcccccgagttcctcggaggcccgtcggtctttctttttccccctaagcctaaagataccctgatgatcagccggacgcctgaggtgact
tgtgtggtagtcgacgtgtcccaagaagatccggaagtccagtttaactggtatgtggatggagtggaggtccataatgccaagacaaagccaaggaggagcaatt
caactcgaagtaccgcgtcgtgtccgtgctcacagtgcttcatcaagactggttgaacggaaaggagtacaaatgtaaggtatcaaacaagggtttgccctcgtcca
tcgagaaaaccatctcgaaagcgaaagggcaaccccgcgagccccaggtatatacgctcccgccttcaagagaagaaatgacgaaaaaccaagtgagcttgtggtgc
ctggtcaaggggttctatccctccgatatcgcggtagagtgggaaagcaatgggcagccggagaacaactataagacaacgcctcccgtgttggactcagatggatc
gttcttcttgtactcaaagcttacggtggacaagtcacgctggcagcaagggaacgtgttttcgtgctcggtgatgcacgaggcgcttcacaatcactacactcaga
aatcgcttagcttgtcaccaggaaaatgataa
(SEQ ID NO:318)

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVCTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*cpscpapeflggpsvflfppkpkdtlmisrtpevt
cvvvdvsqedpevqfnwyvdgvevhnaktkpreeqfnskyrvvsvltvlhqdwlngkeykckvsnkglpssiektiskakGQPREPQVCTLPPCREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:321)

atgggcttcggactgtcgtggctttttctggtggcgattcttaaggggtccagtgcgataagacacacacgtgcccctcgtgccccgcaccggagttccttggggg
tccgtcggtctttttgtttccccctaaacccaaggacacgctcatgatctcccgcacaccggaagtcacgtgcgtagtcgtggatgtctcacaagaggacccggaag
tgcaattcaactggtacgtcgacggcgtggaggtgcacaatgccaagacgaaaccaagagaggaacagttcaactcaaagtaccgggtagtatcggtgttgacggtg
ctccatcaggattggcttaacggtaaagagtacaagtgtaaagtcagcaataagggtctgcccagctccatcgaaaagactatctccaaggccaaggggcagcctcg
cgaaccgcaagtgtgtacgttgcccccgtcccgggaggagatgacgaaaaatcaggtcagcctctcgtgtgcggtgaaggggttttacccatccgacattgcggtgg
aatgggagagcaacggacagcccgaaaacaattacaagactaccccgccagtactcgatagcgacgggtcgttctttcttgtgtcgaaactgacagtggacaagtca
agatggcagcaaggaaatgtgttctcgtgtagcgtgatgcacgaggcactccacaatcattacacacagaagagcttgtccctctcccctggtaaaggaggaggagg
gtcgggtgggggaggcagcgggggaggaggatcaggaggtgggggttcaggcggaggggggttcgggtggtgggggatcgggaggtggaggttcggaggagggggct
cctgtccgagctgccccgctcccgagttcttgggaggtccctcagtgtttcttttcccgccgaagcctaaagatacactgatgatttcacgaacccccgaagtgaca
tgcgtagtagtagatgtgtcgcaagaagatccggaagtccagttcaattggtatgtggatggggtggaggtccataatgcgaaaacaaaaccgcgggaagagcaatt
caattcaaagtatagggtcgtcagcgtgctcacagtgctgcaccaggactggcttaatgggaaagaatacaagtgcaaggtatccaacaaggggttgccctcgtcga
tcgagaaaacgatttcaaaagccaagggacaaccgagggaaccacaagtatgcacgctgccgccgtgtagggaagaaatgacgaagaaccaagtgagcctctggtgc
ctggtgaagggcttttatccctccgacatcgcagtcgagtgggaatcgaatgggcagccggagaacaactataagactactcccccagtgttggattcggatggatc
atttttcctctactcgaaacttacggtcgacaaatcacgctggcagcagggcaacgtgttttcctgctcggtaatgcatgaggcgcttcacaaccactatacccaga
agtcactgtcgcttagcccagggaaatgataa
(SEQ ID NO:320)

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLTCLVKGFYPSDIAVEWESNGQPENNYKTTPPVLDSDGSFFLTSKLTVDKS
RWQQGNVFSCSVMHEALHNHYTQKSLSLSPGK*GGGGSGGGGSGGGGSGGGGSGGGGSGGGGSGGGGSGGGGS*cpscpapeflggpsvflfppkpkdtlmisrtpevt
cvvvdvsqedpevqfnwyvdgvevhnaktkpreeqfnskyrvvsvltvlhqdwlngkeykckvsnkglpssiektiskakGQPREPQVYTLPPSREEMTKNQVSLYC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:323)

atgggcttcggactgtcgtggctttttctggtggcgattcttaaggggtccagtgcgacaagacccatacgtgcccatcgtgccccgcaccggagttcctcggagg
cccgtcagtattcctttttcctccgaagcccaaagatacattgatgatcagcaggacgcctgaagtgacatgtgtagtggtagacgtgtcgcaagaagatccagagg
tacagtttaactggtatgtcgacggggtggaagtccataacgccaagactaaaccccgcgaagagcagttcaactcaaagtatagagtagtctccgtcctgacagtc
ctccatcaggactggctgaacgggaaagaatacaagtgcaaagtctcgaacaaagggcttccgtcatcgatcgagaaaacgatttcaaaagccaagggacagcctag
ggagccgcaagtgtatactctgcccccgtcgcgcgaggagatgacgaaaaatcaggtgtccctcacgtgcctcgtcaaaggattttacccgtcggatatcgccgtgg
agtgggaatcgaatgggcaaccagagaacaactacaagaccactcccccggtgctggactcggacggctcctttttcttgacatcaaagctcacagtcgataagagc
cgctggcaacaagggaatgtgttcagctgctcggtgatgcacgaagcgctgcacaaccactatacccagaaatcattgtccctcagccccggaaagggaggtggagg
gtccggtggggtggatcaggaggggggtgggagcggaggaggcggcagcggtggcggagggtcaggtggaggcggatcaggtggggaggttcaggcggtggggct
cgtgccccagctgtcctgctcccgagtttctcggggaccttcagtctttctcttccctccgaaacccaaggacacgctgatgatttcgcggacacccgaagtgact
tgtgtcgtggtcgacgtaagccaggaggaccccgaggtgcaattcaactggtacgtcgacggagtcgaggtccacaatgcgaaaacaaaacccagagaagaacagtt
caattcgaaatatcgagtggtatcagtcctgaccgtgcttcatcaggattggctcaatgggaaagagtacaaatgcaaggtatcaaacaagggactgccaagctcaa
tcgaaaagactatctcgaaagcaaagggtcagcctcgggagccccaagtgtacacgcttcccccatccagggaagaaatgacgaagaaccaggtgtcgctctactgt
ttggtgaaggggttttatccttcggacatcgcggtggaatgggagtcgaatggacagccggagaataactacaaaacgactccgcctgtcctcgacagcgatgggtc
cttcttcctttactcaaaattgacagtagataagtcgcgctggcagcagggaaatgtattctcctgttccgtcatgcatgaggcgcttcacaatcactacactcaga
agtccttgtcgttgtcaccaggaaaatgataa
(SEQ ID NO:322)

MGFGLSWLFLVAILKGVQCDKTCCcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*cpscpapeflggpsvflfppkpkdtlmisrtpevt
cvvvdvsqedpevqfnwyvdgvevhnaktkpreeqfnskyrvvsvltvlhqdwlngkeykckvsnkglpssiektiskakGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:325)

atgggcttcggactgtcgtggctttttctggtggcgattcttaaggggtccagtgcgacaagacatgctgttgcccaagctgtcccgctccggagtttctcggtgg
accgtcggtgtttctgttccctccgaagccaaaagataccttgatgatttcgcgaactcccgaagtcacgtgtgtcgtcgtggacgtaagccaggaggacccggagg
tccagttcaattggtatgtagacggcgtagaggtacataatgcgaaaacgaagcccagagaggaacagttcaatagcaaataccgcgtagtatcggtgctgacagtg
ttgcaccaggactggctgaatggaaaagaatacaagtgtaaagtgtccaacaagggccttccatcgtcgattgaaaagacaatctccaaggcaaaggggcagcctag
ggagccccaagtctacaccctgcccccttcgcgggaggagatgacgaagaaccaggtatcactgtcatgcgcggtcaaaggatttacccgagcgacatcgccgtag
aatgggagtccaacggacagccagaaaacaattacaagaccactcctccagtgctcgatagcgatggctccttctttcttgtcagcaaattgacagtcgataagtca
agatggcagcagggtaatgtgttctcatgtagcgtcatgcacgaagcactccacaatcattatacacagaagagcctctcgttgtcgcccggaaaggcggaggtgg
gtcgggcggaggggggaagcggtggaggagggtcaggaggtggaggttccgggggaggcggttcgggaggaggggggttcgggtggtggaggatcgggtggcggaggaa
gctgcccttcatgtccagcccccgagttcctcggaggcccgtcggtctttctttttcccccctaagcctaaagataccctgatgatcagccggacgcctgaggtgact
tgtgtggtagtcgacgtgtcccaagaagatccggaagtccagtttaactggtatgtggatggagtggaggtccataatgccaagacaaagccaagggaggagcaatt
caactcgaagtaccgcgtcgtgtccgtgctcacagtgcttcatcaagactggttgaacggaaaggagtacaaatgtaaggtatcaaacaagggtttgccctcgtcca
tcgagaaaaccatctcgaaagcgaaagggcaaccccgcgagccccaggtatatacgctcccgccttcaagagaagaaatgactaaaaaccaagtgagcttgtggtgc
ctggtcaaggggttctatccctccgatatcgcggtagagtgggaaagcaatgggcagccggagaacaactataagacaacgcctcccgtgttggactcagatggatc
gttcttcttgtactcaaagcttacggtggacaagtcacgctggcagcaagggaacgtgttttcgtgctcggtgatgcacgaggcgcttcacaatcactacactcaga
aatcgcttagcttgtcaccaggaaaatgataa
(SEQ ID NO:324)

MGFGLSWLFLVAILKGVQCDKCHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK*GGGGSGGGGSGGGGSGGGGSGGGGSGGGGSGGGGSGGGGS*cpscpapeflggpsvflfppkpkdtlmisrtpevt
cvvvdvsqedpevqfnwyvdgvevhnaktkpreeqfnskyrvvsvltvlhqdwlngkeykckvsnkglpssiektiskakGQPREPQVYTLPPSREEMTKNQVSLWC
LVKGFYPSDIAVEWESNGQPENNYKTTPPVLDSDGSFFLYSKLTVDKSRWQQGNVFSCSVMHEALHNHYTQKSLSLSPGK
(SEQ ID NO:327)

atgggcttcggactgtcgtggctttttctggtggcgattcttaaggggtccagtgcgacaagtgccatacatgcccaagctgtcccgctccggagtttctcggtgg
accgtcggtgtttctgttccctccgaagccaaaagataccttgatgatttcgcgaactcccgaagtcacgtgtgtcgtcgtggacgtaagccaggaggacccggagg
tccagttcaattggtatgtagacggcgtagaggtacataatgcgaaaacgaagcccagagaggaacagttcaatagcaaataccgcgtagtatcggtgctgacagtg
ttgcaccaggactggctgaatggaaaagaatacaagtgtaaagtgtccaacaagggccttccatcgtcgattgaaaagacaatctccaaggcaaaggggcagcctag
ggagccccaagtctacaccctgccccttcgcgggaggagatgacgaagaaccaggtatcactgtcatgcgcggtcaaaggatttacccgagcgacatcgccgtag
aatgggagtccaacggacagccagaaaacaattacaagaccactcctccagtgctcgatagcgatggctccttctttcttgtcagcaaattgacagtcgataagtca
agatggcagcagggtaatgtgttctcatgtagcgtcatgcacgaagcactccacaatcattatacacagaagagcctctcgttgtcgcccggaaaggcggaggtgg
gtcgggcggaggggaagcggtggaggagggtcaggaggtggaggttccgggggaggcggttcgggaggaggggttcgggtggtggaggatcgggtggcggaggaa
gctgcccttcatgtccagcccccgagttcctcggaggcccgtcggtctttctttttccccctaagcctaaagataccctgatgatcagccggacgcctgaggtgact
tgtgtggtagtcgacgtgtcccaagaagatccggaagtccagtttaactggtatgtggatggagtggaggtccataatgccaagacaaagccaagggaggagcaatt
caactcgaagtaccgcgtcgtgtccgtgctcacagtgcttcatcaagactggttgaacggaaaggagtacaaatgtaaggtatcaaacaagggtttgccctcgtcca
tcgagaaaaccatctcgaaagcgaaagggcaaccccgcgagccccaggtatatacgctcccgccttcaagagaagaaatgacgaaaaaccaagtgagcttgtggtgc
ctggtcaaggggttctatccctccgatatcgcggtagagtgggaaagcaatggcagccggagaacaactataagacaacgcctcccgtgttggactcagatggatc
gttcttcttgtactcaaagcttacggtggacaagtcacgctggcagcaagggaacgtgttttcgtgctcggtgatgcacgaggcgcttcacaatcactacactcaga
aatcgcttagcttgtcaccaggaaaatgataa
(SEQ ID NO:326)

*Fig. 11*
(Cont'd)

39E: T366S/L368A/Y407V/CH3 C-terminal Cysteine KSCDKT::T366W/CH3 C-terminal Cysteine GEC MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGSGGGGSGGGGS*cpscpapeflggpsvflfppkpkdtlmisrtp
evtcvvvdvsqedpevqfnwyvdgvevhnaktkpreeqfnskyrvvsvltvlhqdwlngkeykckvsnkglpssiektiskakGQPREPQVYTLPPSREEMTKNQVS
LWCLVKGFYPSDIAVEWESNGQPENNYKTTPPVLDSDGSFFLYSKLTVDKSRWQQGNVFSCSVMHEALHNHYTQKSLSLSGEC
(SEQ ID NO:329)

atgggcttcggactgtcgtggctttttctggtggcgattcttaaggggtccagtgcgataaaacgcacacgtgcccctcgtgtccggcaccggagtttcttggagg
tccctcggtgttcctgttccctcccaagccgaaggacacgttgatgatttcgaggacgccggaggtgacgtgtgtggtcgtagacgtgagccaggaggacccggaag
tgcagtttaactggtacgtcgatggagtagaagtacataatgccaagacgaagcccagggaggaacaattcaattcgaagtatcgcgtcgtatccgtgctgactgtg
ctccaccaggactggcttaacggaaaagaatacaagtgcaaggtatcaaataagggactcccctcgtcgatcgagaaaacaatcagcaaagcgaaaggacagccgag
ggaaccgcaagtgtacacattgccgccgtcgcgagaagaaatgaccaagaaccaggtatcactctcgtgcgccgtgaagggcttttacccatcggacattgctgtgg
agtgggagagcaacggtcaacccgagaataactacaaaactacaccgcccgtgctggattccgacggctcattctttctcgtgtcaaaactgactgtggataagtcg
cgctggcaacaggggaatgtgttctcgtgcagcgtcatgcatgaagctcttcataatcactacacccaaaaatccctgtcactctcgaaaagctgtgataagaccgg
gggtgggggctccggaggaggcggttcgggtggcggtgggtcgggtggaggcggatcgggcggtgggggaagcggtggtggtggaagcggagggggtggatcaggtg
gaggggcagctgtccatcctgccctgcaccagagtttttgggaggaccgtccgtatttctgtttccgcccaagcccaaagatactttgatgatcagcaggacgcct
gaggtaacatgtgtagtggtcgatgtctcgcaagaggaccctgaggtccagttcaattggtacgtggacggggtggaagtccacaacgcgaaaacgaaaccacgcga
agaacagttcaacagcaaatacagagtcgtgtcagtcttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgccgccctcgcgggaggagatgacaaagaatcaggtgtcg
ctgtggtgtctggtaaaaggattctatccatccgatatcgcggtagagtgggaatcaaacggccagccggagaacaattacaagaccacgcccccctgtattggattc
ggacggatcgttcttcttgtattcgaaactcacggtggacaagtcgcggtggcagcagggtaatgtgttttcatgctcagtcatgcacgaggcgctccataaccatt
atactcagaagtcgctgtccttgtccggggagtgctgataa
(SEQ ID NO:328)

*Fig. 11*
(Cont'd)

39E (35L): T366S/L368A/Y407V/CH3 C-terminal Cysteine KSCDKT::T366W/CH3 C-terminal Cysteine GEC and (G4S)7

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakgQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGSGGGGS*cpscpapeflggpsvflfppkpkdtlmisrtpevtcv
vvdvsqedpevqfnwyvdgvevhnaktkpreeqfnskyrvvsvltvlhqdwlngkeykckvsnkglpssiektiskakGQPREPQVYTLPPSREEMTKNQVSLWCLV
KGFYPSDIAVEWESNGQPENNYKTTPPVLDSDGSFFLYSKLTVDKSRWQQGNVFSCSVMHEALHNHYTQKSLSLSGEC
(SEQ ID NO:331)

atgggcttcggactgtcgtggctttttctggtggcgattcttaaggggtccagtgcgacaaaacgcacacctgtccgtcatgtcctgccccggaattccttggagg
gccttccgtgtttctcttccctccgaagcccaaggacacgctgatgatctcccggaccccggaggtcacgtgtgtggtagtagacgtgtcacaagaagatccggagg
tgcagttcaactggtacgtagatggcgtggaggtgcacaacgccaaaacgaagccccgagaggaacagttcaattcgaagtaccgcgtcgtgtcggtattgactgta
ttgcatcaagactggttgaacgggaaggagtataagtgtaaagtcagcaacaagggacttccctcgtcaattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgtcgaaaagctgcgacaagacggg
agggggagggtccgggggtggtgggagcggcggaggaggtagcggcggaggtggctcgggaggaggtgggtcgggtggtggggaagcggaggcggagggtcatgtc
cgagctgcccggcacccgaatttctcggaggtccctcggtgttcctgttcccgccaaagcctaaggatacgttgatgatttcgcgcacgccggaggtaacatgcgtg
gtggtggatgtgtcacaagaggaccccgaggtccagttcaattggtacgtcgatggagtggaagtgcacaatgcgaaaacaaaaccccgggaggagcagttcaatag
caagtacagggtagtctccgtcctgactgtacttcaccaagactggcttaacggaaaagagtataagtgcaaggtcagcaacaaggggcttccttcatccatcgaga
aaaccatctcgaaggccaagggacagccgagggagcctcaagtatacacgctgccgccatcgagagaagaaatgaccaaaaaccaggtgtccctttggtgtttggtg
aagggtttctatccctccgatatcgccgtagagtgggagtcaaatggacagcctgagaacaactataagactacgccccctgtgttggacagcgatgggtcattctt
tctgtattcgaaactcacggtggataagtcgcgatggcaacagggcaatgtgttttcgtgcagcgtgatgcatgaggcgctgcacaaccactatactcagaaatcgt
taagcttatcgggagagtgttgataa
(SEQ ID NO:330)

*Fig. 11*
(Cont'd)

39E (35L) Inverted: T366S/L368A/Y407V/CH3 C-terminal Cysteine GEC::T366W/CH3 C-terminal Cysteine KSCDKT and (G4S)7

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSGEC*GGGGSGGGGSGGGGSGGGGSGGGGSGGGGSGGGGS*cpscpapeflggpsvflfppkpkdtlmisrtpevtcvvvd
vsqedpevqfnwyvdgvevhnaktkpreeqfnskyrvvsvltvlhqdwlngkeykckvsnkglpssiektiskakGQPREPQVYTLPPSREEMTKNQVSLWCLVKGF
YPSDIAVEWESNGQPENNYKTTPPVLDSDGSFFLYSKLTVDKSRWQQGNVFSCSVMHEALHNHYTQKSLSLSKSCDKT
(SEQ ID NO:333)

atgggcttcggactgtcgtggctttttctggtggcgattcttaaggggtccagtgcgacaaaacgcacacctgtccgtcatgtcctgccccggaattccttggagg
gccttccgtgtttctcttccctccgaagcccaaggacacgctgatgatctcccggaccccggaggtcacgtgtgtggtagtagacgtgtcacaagaagatccggagg
tgcagttcaactggtacgtagatggcgtggaggtgcacaacgccaaaacgaagccccgagaggaacagttcaattcgaagtaccgcgtcgtgtcggtattgactgta
ttgcatcaagactggttgaacgggaaggagtataagtgtaaagtcagcaacaagggacttccctcgtcaattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgtcgggggaatgcggagggggagg
gtccggagggggagggtccgggggtggtgggagcggcggaggaggtagcggcggaggtggctcgggaggaggtgggtcgggtggtgggggatcatgtccgagctgcc
cggcacccgaatttctcggaggtccctcggtgttcctgttcccgccaaagcctaaggatacgttgatgatttcgcgcacgccggaggtaacatgcgtggtggtggat
gtgtcacaagaggaccccgaggtccagttcaattggtacgtcgatggagtggaagtgcacaatgcgaaaacaaaaccccgggaggagcagttcaatagcaagtacag
ggtagtctccgtcctgactgtacttcaccaagactggcttaacggaaaagagtataagtgcaaggtcagcaacaaggggcttccttcatccatcgagaaaaccatct
cgaaggccaagggacagccgagggagcctcaagtatacacgctgccgccatcgagagaagaaatgaccaaaaaccaggtgtccctttggtgtttggtgaagggtttc
tatccctccgatatcgccgtagagtgggagtcaaatggacagcctgagaacaactataagactacgcccccctgtgttggacagcgatgggtcattctttctgtattc
gaaactcacggtggataagtcgcgatggcaacagggcaatgtgttttcgtgcagcgtgatgcatgaggcgctgcacaaccactatactcagaaatcgttaagcttat
cgaagtcatgcgacaagacttgataa
(SEQ ID NO:332)

Fig. 11
(Cont'd)

39E (30L): T366S/L368A/Y407V/CH3 C-terminal Cysteine KSCDKT::T366W/CH3 C-terminal Cysteine GEC and (G4S)6

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGSGGGGS*cpscpapeflggpsvflfppkpkdtlmisrtpevtcvvvdvs
qedpevqfnwyvdgvevhnaktkpreeqfnskyrvvsvltvlhqdwlngkeykckvsnkglpssiektiskakGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLSGEC
(SEQ ID NO:335)

atgggcttcggactgtcgtggctttttctggtggcgattcttaaggggtccagtgcgacaaaacgcacacctgtccgtcatgtcctgccccggaattccttggagg
gccttccgtgtttctcttccctccgaagcccaaggacacgctgatgatctcccggaccccggaggtcacgtgtgtggtagtagacgtgtcacaagaagatccggagg
tgcagttcaactggtacgtagatggcgtggaggtgcacaacgccaaaacgaagccccgagaggaacagttcaattcgaagtaccgcgtcgtgtcggtattgactgta
ttgcatcaagactggttgaacgggaaggagtataagtgtaaagtcagcaacaagggacttccctcgtcaattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacggtcgttcttccttgtgagcaagctcacggtcgacaaaagc
cgctggcagcagggaaacgtattctcatgttcggtgatgcacgaagcattgcataaccactacacgcagaagagcttgtcgttgtcgaaaagctgcgacaagacggg
agggggagggtccgggggtggtgggagcggcggaggaggtagcggcggaggtggctcgggaggaggtgggtcgggtggtgggggatcatgtccgagctgcccggcac
ccgaatttctcggaggtccctcggtgttcctgttcccgccaaagcctaaggatacgttgatgatttcgcgcacgccggaggtaacatgcgtggtggtggatgtgtca
caagaggaccccgaggtccagttcaattggtacgtcgatggagtggaagtgcacaatgcgaaaacaaaaccccgggaggagcagttcaatagcaagtacagggtagt
ctccgtcctgactgtacttcaccaagactggcttaacggaaaagagtataagtgcaaggtcagcaacaaggggcttccttcatccatcgagaaaaccatctcgaagg
ccaagggacagccgagggagcctcaagtatacacgctgccgccatcgagagaagaaatgaccaaaaaccaggtgtccctttggtgtttggtgaagggtttctatccc
tccgatatcgccgtagagtgggagtcaaatggacagcctgagaacaactataagactacgcccccctgtgttggacagcgatgggtcattctttctgtattcgaaact
cacggtggataagtcgcgatggcaacagggcaatgtgttttcgtgcagcgtgatgcatgaggcgctgcacaaccactatactcagaaatcgttaagcttatcgggag
agtgttgataa
(SEQ ID NO:334)

*Fig. 11*
(Cont'd)

39E (25L): T366S/L368A/Y407V/CH3 C-terminal Cysteine KSCDKT::T366W/CH3 C-terminal Cysteine GEC and (G4S)5

MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSKSCDKT*GGGGSGGGGSGGGGSGGGGSGGGGS*cpscpapeflggpsvflfppkpkdtlmisrtpevtcvvvdvsqedpe
vqfnwyvdgvevhnaktkpreeqfnskyrvvsvltvlhqdwlngkeykckvsnkglpssiektiskakGQPREPQVYTLPPSREEMTKNQVSLWCLVKGFYPSDIAV
EWESNGQPENNYKTTPPVLDSDGSFFLYSKLTVDKSRWQQGNVFSCSVMHEALHNHYTQKSLSLSGEC
(SEQ ID NO:337)

atgggcttcggactgtcgtggctttttctggtggcgattcttaaggggtccagtgcgacaaaacgcacacctgtccgtcatgtcctgccccggaattccttggagg
gccttccgtgtttctcttccctccgaagcccaaggacacgctgatgatctcccggaccccggaggtcacgtgtgtggtagtagacgtgtcacaagaagatccggagg
tgcagttcaactggtacgtagatggcgtggaggtgcacaacgccaaaacgaagccccgagaggaacagttcaattcgaagtaccgcgtcgtgtcggtattgactgta
ttgcatcaagactggttgaacgggaaggagtataagtgtaaagtcagcaacaagggacttccctcgtcaattgaaaagacaatttcgaaagccaaaggccagcccag
ggagccccaagtgtacaccctgccacccagccgggaagagatgacaaagaatcaagtctcgcttagctgcgctgtcaagggcttctatccatcggacattgcagtgg
aatgggaatcaaacggacagccggagaataactataagacgacacccccctgtcctcgacagcgacgggtcgttcttccttgtgagcaagctcacggtcgacaaaagc
cgctggcagcagggaaacgtattctcatgttcggtgatgcacgaagcattgcataaccactacacgcagaagagcttgtcgttgtcgaaaagctgcgacaagacggg
agggggagggtccgggggtggtgggagcggcggaggaggtagcggcggaggtggctcgggaggaggtgggtcatgtccgagctgcccggcacccgaatttctcggag
gtccctcggtgttcctgttcccgccaaagcctaaggatacgttgatgatttcgcgcacgccggaggtaacatgcgtggtggtggatgtgtcacaagaggaccccgag
gtccagttcaattggtacgtcgatggagtggaagtgcacaatgcgaaaacaaaaccccgggaggagcagttcaatagcaagtacagggtagtctccgtcctgactgt
acttcaccaagactggcttaacggaaaagagtataagtgcaaggtcagcaacaaggggcttccttcatccatcgagaaaaccatctcgaaggccaagggacagccga
gggagcctcaagtatacacgctgccgccatcgagagaagaaatgaccaaaaaccaggtgtccctttggtgtttggtgaagggtttctatccctccgatatcgccgta
gagtgggagtcaaatggacagcctgagaacaactataagactacgccccctgtgttggacagcgatgggtcattctttctgtattcgaaactcacggtggataagtc
gcgatggcaacagggcaatgtgttttcgtgcagcgtgatgcatgaggcgctgcacaaccactatactcagaaatcgttaagcttatcgggagagtgttgataa
(SEQ ID NO:336)

*Fig. 11*
(Cont'd)

39I - S364H/F405A::Y349T/T394F with CH3 C-terminal disulfide
MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVHLTCLVKGFYPSDIAVEWESNGQPENNYKTTPPVLDSDGSFALYSKLTVDKS
RWQQGNVFSCSVMHEALHNHYTQKSLSLSKSCDKTGGGGSGGGGSGGGGSGGGGSGGGGSGGGGSGGGGSGGGGScpscpapeflggpsvflfppkpkdtlmisrtp
evtcvvvdvsqedpevqfnwyvdgvevhnaktkpreeqfnskyrvvsvltvlhqdwlngkeykckvsnkglpssiektiskakGQPREPQVTTLPPSREEMTKNQVS
LTCLVKGFYPSDIAVEWESNGQPENNYKTFPPVLDSDGSFFLYSKLTVDKSRWQQGNVFSCSVMHEALHNHYTQKSLSLSGEC
(SEQ ID NO:339)

atgggcttcggactgtcgtggctttttctggtggcgattcttaaggggtccagtgcgacaaaacgcacacttgtccttcctgccctgccccggagttccttggcgg
accctcggtctttttgtttccgccgaaaccgaaagacacccttatgattagcaggacacccgaagtcacgtgtgtcgtcgtggacgtgtcgcaagaggatcccgagg
tgcagttcaactggtacgtggacggggtagaagtccacaatgccaagacaaaaccccgggaagaacagtttaactcgaagtaccgcgtagtgtcagtcttgacagtc
ctccatcaggactggcttaacgggaaggagtacaaatgtaaagtgtcaaacaagggtctgccttccagcattgagaaaacgatctccaaggctaaagggcagccccg
agaaccacaagtctatacgcttccaccatcgcgggaggagatgaccaagaaccaggtccacttgacctgtctcgtgaaggggttctacccgtcagatatcgcggtag
agtgggaatcgaacggccagcccgagaataactacaagacgactcctccggtcctcgattcagatgggtcgttcgcactctactcaaaacttacggtggacaagtcg
agatggcagcagggcaacgtgtttagctgctcagtcatgcacgaggcgctgcataatcactatacacagaagtcgctgtcattgtcaaaaagctgcgacaagacagg
gggtggaggttcaggcggtggtgggtcgggaggggggagggtcaggtggaggcggcagcgggggtgggggatcgggaggaggagggtccgggggaggggggttccggag
gggtgggtcctgtccgtcgtgccctgcaccggaattcttgggcggtccgtcagtgttcctgtttcccccgaaacccaaagatacgctcatgatttcccgcacccct
gaggtcacttgcgtggtagtcgatgtcagccaggaagatcccgaagtacagttcaattggtacgtagatggtgtagaagtacacaacgctaaaactaagcctcgcga
agagcagttcaattcgaagtatcgggtagtaagcgtgctgactgtgctccatcaagactggctgaatggaaaagagtataagtgcaaagtctcgaataagggattgc
ccagctccatcgagaaaaccatctcgaaagcgaagggacagcccagagaaccccaagtgaccacattgccaccctcccgagaggaaatgactaagaatcaagtgtca
ctcacatgtcttgtgaagggattctatcccagcgacatcgccgtcgagtgggagtccaatgggcagccggaaaacaattacaaaacgtttccacccgtccttgactc
agatggatcgttctttctctattcgaagctcacggtagataagtcgaggtggcaacaaggaaatgtgttttcatgttcggtgatgcatgaagcgctccataaccact
atacgcagaaatcgctttcgctctccggtgaatgctgataa
(SEQ ID NO:338)

Fig. 11
(Cont'd)

39J - K370D/K392D/K409D::E356K/E357K/D399K with CH3 C-terminal disulfide
MGFGLSWLFLVAILKGVQCDKTHTcpscpapeflggpsvflfppkpkdtlmisrtpevtcvvvdvsqedpevqfnwyvdgvevhnaktkpreeqfnskyrvvsvltv
lhqdwlngkeykckvsnkglpssiektiskakGQPREPQVYTLPPSREEMTKNQVSLTCLVDGFYPSDIAVEWESNGQPENNYDTTPPVLDSDGSFFLYSDLTVDKS
RWQQGNVFSCSVMHEALHNHYTQKSLSLSKSCDKT*GGGGSGGGGSGGGGSGGGGSGGGGSGGGGSGGGGSGGGGS*cpscpapeflggpsvflfppkpkdtlmisrtp
evtcvvvdvsqedpevqfnwyvdgvevhnaktkpreeqfnskyrvvsvltvlhqdwlngkeykckvsnkglpssiektiskakGQPREPQVYTLPPSRKKMTKNQVS
LTCLVKGFYPSDIAVEWESNGQPENNYKTTPPVLKSDGSFFLYSKLTVDKSRWQQGNVFSCSVMHEALHNHYTQKSLSLSGEC
(SEQ ID NO:341)

atgggcttcggactgtcgtggctttttctggtggcgattcttaagggggtccagtgcgacaaaacgcacacttgtccttcctgccctgccccggagttccttggcgg
accctcggtctttttgtttccgccgaaaccgaaagacacccttatgattagcaggacacccgaagtcacgtgtgtcgtcgtggacgtgtcgcaagaggatcccgagg
tgcagttcaactggtacgtggacggggtagaagtccacaatgccaagacaaaacccgggaagaacagtttaactcgaagtaccgcgtagtgtcagtcttgacagtc
ctccatcaggactggcttaacgggaaggagtacaaatgtaaagtgtcaaacaagggtctgccttccagcattgagaaaacgatctccaaggctaaaggacagccaag
agagcctcaagtctatacattgcccccgagccgggaggaaatgaccaaaaaccaggtatcgcttacgtgcttggtggacgggttttacccttcagacatcgcagtgg
agtgggaatccaacgggcagccagagaacaattacgataccactccacccgtgcttgacagcgatggctcattcttcctctattccgacttgaccgtcgataagtca
cgatggcagcaggggaatgtgtttagctgttcggtcatgcacgaagcgctgcacaaccactacacgcagaagtcgctctcattgtccaaaagctgcgacaagacagg
gggtggaggttcaggcggtggtgggtcgggaggggga gggtcaggtggaggcggcagcgggggtgggggatcgggaggaggagggtccgggggaggggggttccggag
ggggtgggtcctgtccgtcgtgccctgcaccggaattcttgggcggtccgtcagtgttcctgtttcccccgaaacccaaagatacgctcatgatttcccgcacccct
gaggtcacttgcgtggtagtcgatgtcagccaggaagatcccgaagtacagttcaattggtacgtagatggtgtagaagtacacaacgctaaaactaagcctcgcga
agagcagttcaattcgaagtatcgggtagtaagcgtgctgactgtgctccatcaagactggctgaatggaaaagagtataagtgcaaagtctcgaataagggattgc
ccagctccatcgagaaaaccatctcgaaagcgaagggacagcccagagaaccccaagtgtatacgcttcccccttcaagaaagaagatgactaagaatcaggtgtca
ctcacgtgcctcgtgaagggattctatccgtcggacatcgcggtcgaatgggagtcgaatggacagccggagaacaactacaagacaacacctccagtgctgaaatc
ggatgggagcttctttctgtattcgaagctcacggtagataagtcgaggtggcaacaaggaaatgtgttttcatgttcggtgatgcatgaagcgctccataaccact
atacgcagaaatcgctttcgctctccggtgaatgctgataa
(SEQ ID NO:340)

*Fig. 11*
(Cont'd)

>Ron-23E-2224

EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATII
NDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGK
EYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFS
CSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDV
SHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFY
PSDIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCK
ASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTG
GGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCA
AWDDSLNGYLFGAGTKLTVL**
(SEQ ID NO:350)

>Ron-39Egy4-2224-HC

EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATII
NDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGK
EYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFS
CSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDV
SQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFY
PSDIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCK
ASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTG
GGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCA
AWDDSLNGYLFGAGTKLTVL**
(SEQ ID NO:351)

Fig. 14

>Ron-23E-sm3E
EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATII
NDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGK
EYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFS
CSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDV
SHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFY
PSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCK
ASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGG
GGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYP
LTFGGGTKLEIK**
(SEQ ID NO:352)

>Ron-39Egy4-sm3E
EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATII
NDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGK
EYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFS
CSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDV
SQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFY
PSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCK
ASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGG
GGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYP
LTFGGGTKLEIK**
(SEQ ID NO:353)

Fig. 14
(Cont'd)

>sm3E-23E-Onartuzumab
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKE
YKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSC
SVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVS
HEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAA
SGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGSGGGG
SGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATYYCQQ
YYAYPWTFGQGTKVEIK**
(SEQ ID NO:354)

>sm3E-23E-Ron
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKE
YKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSC
SVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVS
HEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLSGECGGGGSGGGGSEVQLLESGGGLVQPGGSLRLSCAA
SGFTFSDYQMEWVRQAPGKGLEWVSYIYSSGGKTVYADSVKGRFTISRDNSKNTLYLQMNSLRAEDTAVYYCARLPRVGATIINDYWGQGTLVTVSSASTGGGGSGG
GGSGGGGSGGGGSDIQMTQSPSSVSASVGDRVTITCRASRGISSSLAWYQQKPGRAPKLLIYAASSFHTGVPSRFSGSGSVTEFTLTISSLQPEDFATYYCQQTDSF
PLTFGGGTKVEIK
(SEQ ID NO:355)

*Fig. 14*
(Cont'd)

```
>sm3E-39Egy4-Onartuzumab
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKE
YKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSC
SVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVS
QEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAA
SGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGSGGGG
SGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATYYCQQ
YYAYPWTFGQGTKVEIK**
(SEQ ID NO:356)

>Onartuzumab-23E-sm3E
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKAS
GFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGG
SGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLT
FGGGTKLEIK**
(SEQ ID NO:359)
```

Fig. 14
(Cont'd)

>Onartuzumab-39Egy4-sm3E
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKAS
GFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGG
SGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLT
FGGGTKLEIK**
(SEQ ID NO:360)

>Onartuzumab-39Egy4-Biwa6
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVESGGGLVKPGGSLRLSCAAS
GFTFSSYDMSWVRQAPGKGLEWVSTISSGGSYTYYLDSIKGRFTISRDNAKNSLYLQMNSLRAEDTAVYYCARQGLDYWGRGTLVTVSSASTGGGGSGGGGSGGGGS
GGGGSEIVLTQSPATLSLSPGERATLSCSASSSINYIYWYQQKPGQAPRLLIYLTSNLASGVPARFSGSGSGTDFTLTISSLEPEDFAVYYCLQWSSNPLTFGGGTK
VEIK**
(SEQ ID NO:361)

*Fig. 14*
(Cont'd)

>Onartuzumab-23E-Biwa6
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVESGGGLVKPGGSLRLSCAAS
GFTFSSYDMSWVRQAPGKGLEWVSTISSGGSYTYYLDSIKGRFTISRDNAKNSLYLQMNSLRAEDTAVYYCARQGLDYWGRGTLVTVSSASTGGGGSGGGGSGGGGS
GGGGSEIVLTQSPATLSLSPGERATLSCSASSSINYIYWYQQKPGQAPRLLIYLTSNLASGVPARFSGSGSGTDFTLTISSLEPEDFAVYYCLQWSSNPLTFGGGTK
VEIK**
(SEQ ID NO:362)

>Onartuzumab-23E-ARH460-16-2-HC
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAAS
GFDFSRYWMSWVRQAPGKGLVWVGEVNPDSTSINYTPSLKDRFTISRDNAKNTLYLQMNSLRAEDTAVYYCTRPNYYGSRYHYYAMDYWGQGTLVTVSSASTGGGGS
GGGGSGGGGSGGGGSDIQMTQSPSSLSASVGDRVTITCRASQDINNYLNWYQQKPGKAPKLLIYYTSRLHSGVPSRFSGSGSGTDFTFTISSLQPEDIATYYCQQGS
TLPFTFGQGTKLEIK**
(SEQ ID NO:363)

Fig. 14
(Cont'd)

>Onartuzumab-39Egy4-ARH460-16-2-HC
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAAS
GFDFSRYWMSWVRQAPGKGLVWVGEVNPDSTSINYTPSLKDRFTISRDNAKNTLYLQMNSLRAEDTAVYYCTRPNYYGSRYHYYAMDYWGQGTLVTVSSASTGGGGS
GGGGSGGGGSGGGGSDIQMTQSPSSLSASVGDRVTITCRASQDINNYLNWYQQKPGKAPKLLIYYTSRLHSGVPSRFSGSGSGTDFTFTISSLQPEDIATYYCQQGS
TLPFTFGQGTKLEIK**
(SEQ ID NO:364)

>ARH460-16-2-23E-Onartuzumab
EVQLVESGGGLVQPGGSLRLSCAASGFDFSRYWMSWVRQAPGKGLVWVGEVNPDSTSINYTPSLKDRFTISRDNAKNTLYLQMNSLRAEDTAVYYCTRPNYYGSRYH
YYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWL
NGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGN
VFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVV
VDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVK
GFYPSDIAVEWESNGQPENNYKTTPPVLDSDGSFFLYSKLTVDKSRWQQGNVFSCSVMHEALHNHYTQKSLSLSGECGGGGSGGGGEVQLVESGGGLVQPGGSLRLS
CAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGSG
GGGSGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATYY
CQQYYAYPWTFGQGTKVEIK**
(SEQ ID NO:365)

Fig. 14
(Cont'd)

>ARH460-16-2-39Egy4-Onartuzumab
EVQLVESGGGLVQPGGSLRLSCAASGFDFSRYWMSWVRQAPGKGLVWVGEVNPDSTSINYTPSLKDRFTISRDNAKNTLYLQMNSLRAEDTAVYYCTRPNYYGSRYH
YYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWL
NGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGN
VFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVV
VDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVK
GFYPSDIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRL
SCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGS
GGGGSGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATY
YCQQYYAYPWTFGQGTKVEIK**
(SEQ ID NO:366)

>ARH460-16-2-LC
DIQMTQSPSSLSASVGDRVTITCRASQDINNYLNWYQQKPGKAPKLLIYYTSRLHSGVPSRFSGSGSGTDFTFTISSLQPEDIATYYCQQGSTLPFTFGQGTKLEIK
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
**
(SEQ ID NO:367)

Fig. 14
(Cont'd)

Onartuzumab-23-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDP
EVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIA
VEWESNGQPENNYKTTPPVLDSDGSFFLYSKLTVDKSRWQQGNVFSCSVMHEALHNHYTQKSLSLSPGK**
(SEQ ID NO:368)

gaggtgcagttggtagaatcaggagggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactggggggcagggtactcttgtgacagtctcctcggctagcaccaagggacccagcgtgtttccacttgcgccttcgtcaaagtccacaagcggggggaacggcagc
ccttggctgcctggtgaaagactactttcccgaacccgtgacagtatcgtggaatagcggagcgctcacatcgggcgtgcacacatttccggcggtgctgcagtcct
ccgggttgtattcgctgtcgagcgtagtcacggtgccgtcctcgtcactgggaactcagacatacatttgcaacgtcaatcacaaaccgtcaaacacgaaagtcgac
aagaaagtggaaccgaaatcatgcgacaagacccacacttgtcccccatgtcctgccccagagcttctcggggggaccctcggtgttcttgttcccgccgaaaccgaa
agatactctcatgatcagcagaacacccgaagtcacgtgtgtcgtggtagatgtctcccacgaggaccccgaggtgaagtttaactggtatgtagacggggtagagg
tacataatgcgaaaacaaaccccgcgaagaacagtaccagtcaacttatcgcgtcgtgtcagtactcacggtcttgcatcaggactggttgaacggaaggagtac
aaatgtaaggtatcaaacaaggccctcccagcgccgattgagaaaacgatctcgaaagcgaaaggacagcccagggagccgcaagtatacactcttccgccatcacg
ggaggagatgactaagaaccaagtcagcctgagctgcgcggtgaaagggttctatccgtcggatattgcggtggaatgggagtcgaacggccagccggagaacaatt
acaaaaccacgccacccgtcctcgacagcgacggatcgttctttctggtgagcaagttgaccgtcgataagtcgcggtggcaacagggtaatgtgttttcatgctca
gtgatgcatgaggccttgcacaatcattacacacagaagtccctcagcctttcgcctggcaaaggtgggggtgggtcgggaggggggaggatcaggtggtggagggtc
aggaggtggggggatcaggagggggtgggagcggggggaggcgggtccggaggaggcggcagcgggggtgggggctcgtgtccccccttgtccggcacccgagctcttgg
gaggaccttcagtgtttcttttttccgcccaaacccaaagatacccttatgatctcgcgaacccctgaagtcacatgcgtggtcgtggatgtatcgcatgaggacccg
gaggtcaagttcaattggtacgtggacggggtcgaggtgcacaacgctaagacaaaacctcgggaggagcagtatcagtccacatatagggtcgtgtccgtactgac
ggtacttcatcaggattggctcaatgggaaagaatacaagtgcaaggtgtcgaataaggcgttgcctgcacccattgaaaagacgatttcgaaagctaagggtcaac
ccagagaaccccaagtctatacgcttccccccttcccgcgaggaaatgacgaagaatcaggtcagcctctggtgcctggtgaaggggttctacccctccgacatcgcc
gtagagtgggaatccaatgggcagcccgaaaacaactacaagacgacaccgcctgtgttggattcagatgggagcttctttctctattccaaactgacggtggacaa
aagcaggtggcagcaaggaaatgtgttctcgtgctcggtaatgcacgaagcactgcacaaccactacacccagaagtccttgtccctttcgccaggaaaataatag
(SEQ ID NO:369)

Onartuzumab-39-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDP
EVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIA
VEWESNGQPENNYKTTPPVLDSDGSFFLYSKLTVDKSRWQQGNVFSCSVMHEALHNHYTQKSLSLSPGK**
(SEQ ID NO:370)

gaggtgcagttggtagaatcaggaggggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcaccaagggacccagcgtgtttccacttgcgccttcgtcaaagtccacaagcggggggaacggcagc
ccttggctgcctggtgaaagactactttcccgaacccgtgacagtatcgtggaatagcggagcgctcacatcgggcgtgcacacatttccggcggtgctgcagtcct
ccgggttgtattcgctgtcgagcgtagtcacggtgccgtcctcgtcactgggaactcagacatacatttgcaacgtcaatcacaaaccgtcaaacacgaaagtcgac
aaaaaggtggaacctaagtcgtgcgacaaaacacacacctgcccgtcgtgtccagcgcctgagttcttgggtggtccctcggtgtttctttttccgcctaagcccaa
agacacgctcatgatttcgcgcacacccgaagtcacatgcgtggtggtggatgtgagccaggaagatccggaggtacagttcaattggtatgtcgatggggtggagg
tacataatgccaagacgaaaccgagggaggagcagttcaactccaagtatagggtggtgtcagtcttgactgtgttgcaccaagattggcttaacggaaaagagtat
aagtgtaaagtatcgaacaagggactccccagctcaatcgaaaagacgatctcaaaggcgaaaggtcagccacgagaaccccaagtatacacgctgcctccatcgcg
ggaagaaatgacgaaaaaccaagtatcgctttcatgcgctgtgaaggggttctacccgtcggacattgccgtggaatgggaaagcaatgggcagccagagaataact
ataagactacgcccccagtcttggacagcgacgggagctttttcctggtgtccaagttgacagtggacaaatcgcgctggcagcagggaaatgtgttttcctgttcc
gtaatgcatgaagcactccataatcactacacacagaaatcgctttcgctgtcacccgggaagggtgggggtgggtcgggaggggggaggatcaggtggtggagggtc
aggaggtgggggatcaggaggggggtgggagcgggggaggcgggtccggaggaggcggcagcgggggtgggggctcgtgcccttcctgtcccgcacccgagttccttg
gggaccgtcggtctttctcttccctccgaagcccaaggacaccttgatgatctcccggactcccgaagtgacgtgtgtcgtagtagacgtgtcgcaagaggacccc
gaggtccagttcaactggtacgtcgatggcgtggaggtgcacaacgctaaaacaaagcccagagaagagcagtttaacagcaagtatcgggtcgtcagcgtgctgac
cgtccttcatcaggactggcttaatggaaaggaatacaaatgtaaagtctcgaataaggggttgcccagctcgattgagaaaaccatctccaaagcgaaagggcagc
caagagagcctcaagtctatacgcttcccccatcacgcgaagagatgactaagaatcaagtctccctgtggtgcctggtgaagggattctacccttcggatattgcg
gtggagtgggagtccaacggtcagccggagaacaattacaagacgactccgccggtactcgattcagatggatcattctttctctactccaaactcacagtagacaa
atcgaggtggcaacagggaaacgtcttttcatgttcggtaatgcacgaggcccttcacaatcattacacccagaaatcactcagcctgtccccgggaaataatag
(SEQ ID NO:371)

Fig. 14
(Cont'd)

Onartuzumab-23E-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGEC**
(SEQ ID NO:372)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggcccagcgtctttccattggcgccctcgtcgaaatcaaccagcggaggaacagctgc
gcttggttgcctcgtcaaagactacttccccgagccggtaacggtgtcgtggaactccggtgcgctgacatcaggggtgcacacgttccctgctgtccttcagtcaa
gcgggttgtactcgctctcgtccgtggtgacggtgccctccagctcgttgggcacgcagacttacatctgcaatgtgaaccataaacccagcaacactaaagtcgac
aaaaaggtcgaaccaaaatcgtgcgataagacgcacacctgcccaccttgtccggctccggaactcttgggtggtccgtccgtattcttgttcccgcctaagccgaa
ggacactcttatgatttcgaggaccccggaggtcacgtgcgtcgtggtggatgtctcgcatgaggacccggaagtcaaattcaactggtacgtagacggtgtcgagg
tgcataacgcaaagaccaagcccagggaagagcagtaccagtccacgtaccgggtagtgtcggtgctcaccgtgcttcaccaggactggcttaacggaaggaatac
aagtgtaaagtctccaacaaagcgctccctgcccccatcgaaaagaccatttcgaaagcgaaagggcagccacgcgagcctcaagtgtacaccctgccgccgtcccg
ggaagagatgactaagaatcaggtatccctctcatgcgctgtcaagggtttctacccgtcagacatcgcagtggaatgggaatcaaacggccagccggagaataact
acaagacgacgccgcctgtcctcgattccgacgggtcgttcttcctggtgtcgaagttgacagtggacaagtcgcgatggcagcaaggaaacgtcttctcatgctcg
gtaatgcacgaggcgctccataaccactatacacagaaatcgctctccttgtcaaagtcgtgcgataagacgggaggggggtggatcaggtggggaggctcgggagg
gggaggaagcggtggaggagggtcaggaggaggaggcagcgggggcggtggttccggtggtggggggatcaggcggaggcggctcatgcccgccttgtcccgcaccag
aactgcttggagggccttcggtctttctctttcccccgaaacccaaagacaccctgatgatctcacgcactcccgaagtcacatgtgtagtcgtcgatgtgtcgcat
gaagatccggaggtgaagttcaattggtacgtagatggggtcgaagtgcataatgcaaagacgaaaccgcgagaggagcagtatcagtcaacgtatcgcgtagtaag
cgtgttgacggtgctccatcaggattggttgaatggtaaagagtacaagtgcaaggtgtcaaacaaagcgttgccggcccctattgaaaagaccatctcaaaagcca
aggggcaaccccgagagccccaagtatacactctcccgccttcgagagaggagatgactaaaaaccaggtgtcgctttggtgtttggtgaaggggttctatccctcg
gatatcgccgtcgagtgggaatccaatgggcaacccgaaaacaactataagacaacgcctccagtactggactccgacggctcctttttcttgtactccaaattgac
ggtggataagtcgcggtggcagcaggggaatgtgttttcgtgtagcgtgatgcatgaagccctgcataaccactatactcaaaagtcactttccctgtcgggtgaat
gctgataatct
(SEQ ID NO:373)

Fig. 14
(Cont'd)

Onartuzumab-39Eqy4-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGEC**
(SEQ ID NO:374)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggaccttccgtgttcccactggcccctcaagcaaatctaccagtggggaacagcagc
cctgggctgtctggtgaaggattactttccagagcccgtgaccgtcagttggaactcaggggctctgactagcggagtgcacaccttccccgcagtcctgcagtcct
ctgggctgtactccctgagttcagtggtcactgtgcccagctcctctctgggaacacagacttatatctgcaacgtgaatcacaagccttccaataccaaagtcgac
aagaaagtcgagcctaagtcatgtgataaaacccatacatgcccaagctgtcctgcaccagaatttctgggaggaccaagcgtgttcctgtttccacctaagcctaa
agacaccctgatgattagtcgcactccagaggtgacctgtgtggtcgtggacgtcagccaggaggatcccgaagtgcagtttaactggtacgtcgatggcgtggaag
tccacaatgctaagacaaaaccaagagaggaacagttcaacagcaagtacagggtcgtgtccgtgctgactgtcctgcatcaggactggctgaacggaaaagagtat
aagtgcaaagtgagcaataagggcctgcccagttcaatcgagaaaacaatttccaaggcaaaggccagcctcgggaaccacaggtgtataccctgccacccagcag
agaggaaatgacaaagaaccaggtgtcactgagctgtgccgtcaaaggcttttaccctagcgatatcgctgtggagtgggaatccaatgggcagccagaaaacaatt
ataagaccacacctccagtgctggacagcgatggatccttctttctggtgtccaagctgaccgtggacaaatctcggtggcagcagggcaacgtgttctcctgctct
gtcatgcatgaggccctgcacaatcattacacccagaaaagtctgtcactgagcaagtcctgtgataaaacaggaggcggggggatctggcgggggaggcagtgggg
aggcgggtccggaggaggaggaagcggaggaggaggatccggaggaggcgggtctggaggcgggggaagtggaggaggaggatcttgcccaagttgtccagcacctg
agttcctgggaggaccatccgtgttcctgtttccccctaagcccaaagacaccctgatgatcagccggacacctgaagtgacttgcgtcgtggtggacgtgtcccag
gaggatccagaggtccagtttaactggtatgtcgatggcgtggaggtccacaatgctaagaccaaacctcgcgaggaacagttcaactctgactaccgagtggtcag
tgtgctgacagtcctgcatcaggattggctgaacgggaaggaatacaaatgtaaagtgagcaataagggactgccaagctccatcgagaagaccatcagcaaagcca
aaggccagcccagggaacctcaggtgtacactctgccaccctcccgcgaggaaatgaccaagaaccaggtgtctctgtggtgtctggtcaaaggattttatccctct
gacatcgccgtggagtgggaaagtaatggccagcctgaaaacaattacaagactacccctccagtgctggactcagatgggagcttctttctgtatagtaagctgac
cgtggataaatcacggtggcagcagggaaatgtgttctcttgcagtgtcatgcacgaggccctgcataaccattacacacagaagtcattaagcttatccggagagt
gttgataatctagactcgag
(SEQ ID NO:375)

Fig. 14
(Cont'd)

Onartuzumab-23E-Cetuximab-HC
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRISCAVS
GFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGS
GGGGSGGGGSDIVLTQSPSSLSVTPGEKVTFTCRASQSIGTNIHWYQQKPGQSPKLLIKYASESISGVPSRFSGSGSGTDFTLTINSVEAEDAATYYCQQNNNWPTT
FGQGTKLEIK**
(SEQ ID NO:376)

*Fig. 14*
(Cont'd)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggcccagcgtctttccattggcgccctcgtcgaaatcaaccagcggaggaacagctgc
gcttggttgcctcgtcaaagactacttccccgagccggtaacggtgtcgtggaactccggtgcgctgacatcaggggtgcacacgttccctgctgtccttcagtcaa
gcgggttgtactcgctctcgtccgtggtgacggtgccctccagctcgttgggcacgcagacttacatctgcaatgtgaaccataaacccagcaacactaaagtcgac
aaaaaggtcgaaccaaaatcgtgcgataagacgcacacctgcccaccttgtccggctccggaactcttgggtggtccgtccgtattcttgttcccgcctaagccgaa
ggacactcttatgatttcgaggaccccggaggtcacgtgcgtcgtggtggatgtctcgcatgaggacccggaagtcaaattcaactggtacgtagacggtgtcgagg
tgcataacgcaaagaccaagcccagggaagagcagtaccagtccacgtaccgggtagtgtcggtgctcaccgtgcttcaccaggactggcttaacggaaggaatac
aagtgtaaagtctccaacaaagcgctccctgcccccatcgaaaagaccatttcgaaagcgaaagggcagccacgcgagcctcaagtgtacaccctgccgccgtcccg
ggaagagatgactaagaatcaggtatccctctcatgcgctgtcaagggtttctacccgtcagacatcgcagtggaatgggaatcaaacggccagccggagaataact
acaagacgacgccgcctgtcctcgattccgacgggtcgttcttcctggtgtcgaagttgacagtggacaagtcgcgatggcagcaaggaaacgtcttctcatgctcg
gtaatgcacgaggcgctccataaccactatacacagaaatcgctctccttgtcaaagtcgtgcgataagacgggaggggtggatcaggtgggggaggctcgggagg
gggaggaagcggtggaggagggtcaggaggaggaggcagcgggggcggtggttccggtggtgggggatcaggcggaggcggctcatgcccgccttgtcccgcaccag
aactgcttggagggccttcggtctttctctttcccccgaaacccaaagacaccctgatgatctcacgcactcccgaagtcacatgtgtagtcgtcgatgtgtcgcat
gaagatccggaggtgaagttcaattggtacgtagatggggtcgaagtgcataatgcaaagacgaaaccgcgagaggagcagtatcagtcaacgtatcgcgtagtaag
cgtgttgacggtgctccatcaggattggttgaatggtaaagagtacaagtgcaaggtgtcaaacaaagcgttgccggcccctattgaaaagaccatctcaaaagcca
aggggcaaccccgagagccccaagtatacactctcccgccttcgagagaggagatgactaaaaaccaggtgtcgctttggtgtttggtgaaggggttctatccctcg
gatatcgccgtcgagtgggaatccaatgggcaacccgaaaacaactataagacaacgcctccagtactggactccgacggctcctttttcttgtactccaaattgac
ggtggataagtcgcggtggcagcaggggaatgtgttttcgtgtagcgtgatgcatgaagccctgcataaccactatactcaaaagtcactttccctgtcgggtgaat
gcggcggaggtgggtccgggggtgggggatcccaggtgcagctggtggagtctggaggaggagtggtgcagccaggagaatccctgaggatttcttgtgccgtgtca
ggcttcagcctgactaattacggggtgcactgggtgcgccaggctccaggcaaagggctggagtggctgggcgtgatctggtccggagggaatacagactacaacac
ccctttcacaagtaggctgaccatttcaaaggataactcaaaaagcacagtgtatttccagatgaacagcctgcgggccgaggacacagccgtgtactattgcgcca
gagctctgacttactatgattacgaattcgcctattggggacagggcactctggtgaccgtgagcagcgccagcaccggaggaggaggaagcggcggaggaggctcc
ggaggaggcgggtctggaggcgggggaagtgacatcgtgctgactcagtcaccatctagtctgagcgtgacccccggcgagaaagtgactttacctgccgggcctc
ccagtctatcggaaccaatattcattggtatcagcagaaacccggccagtcccctaagctgctgatcaaatatgctagtgaatcaattagcggcgtgcccagccggt
tcagcgggtctggaagtggcaccgactttacactgactatcaacagtgtggaggccgaagatgccgctacatactattgtcagcagaacaataactggcctaccaca
tttgggcagggaacaaagctggagatcaagtgataa
(SEQ ID NO:377)

*Fig. 14*
(Cont'd)

Onartuzumab-23E-Panitumumab-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVQLQESGPGLVKPSETLSLTCTVS
GGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSG
GGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAF
GGGTKVEIKRT**
(SEQ ID NO:378)

*Fig. 14*
(Cont'd)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggcccagcgtctttccattggcgccctcgtcgaaatcaaccagcggaggaacagctgc
gcttggttgcctcgtcaaagactacttccccgagccggtaacggtgtcgtggaactccggtgcgctgacatcaggggtgcacacgttccctgctgtccttcagtcaa
gcgggttgtactcgctctcgtccgtggtgacggtgccctccagctcgttgggcacgcagacttacatctgcaatgtgaaccataaacccagcaacactaaagtcgac
aaaaaggtcgaaccaaaatcgtgcgataagacgcacacctgcccaccttgtccggctccggaactcttgggtggtccgtccgtattcttgttcccgcctaagccgaa
ggacactcttatgatttcgaggaccccggaggtcacgtgcgtcgtggtggatgtctcgcatgaggacccggaagtcaaattcaactggtacgtagacggtgtcgagg
tgcataacgcaaagaccaagcccagggaagagcagtaccagtccacgtaccgggtagtgtcggtgctcaccgtgcttcaccaggactggcttaacgggaaggaatac
aagtgtaaagtctccaacaaagcgctccctgcccccatcgaaaagaccatttcgaaagcgaaagggcagccacgcgagcctcaagtgtacaccctgccgccgtcccg
ggaagagatgactaagaatcaggtatccctctcatgcgctgtcaagggtttctacccgtcagacatcgcagtggaatgggaatcaaacggccagccggagaataact
acaagacgacgccgcctgtcctcgattccgacgggtcgttcttcctggtgtcgaagttgacagtggacaagtcgcgatggcagcaaggaaacgtcttctcatgctcg
gtaatgcacgaggcgctccataaccactatacacagaaatcgctctccttgtcaaagtcgtgcgataagacgggaggggggtggatcaggtgggggaggctcgggagg
gggaggaagcggtggaggagggtcaggaggaggaggcagcgggggcggtggttccggtggtggggggatcaggcggaggcggctcatgcccgccttgtcccgcaccag
aactgcttggagggccttcggtctttctctttcccccgaaacccaaagacaccctgatgatctcacgcactcccgaagtcacatgtgtagtcgtcgatgtgtcgcat
gaagatccggaggtgaagttcaattggtacgtagatggggtcgaagtgcataatgcaaagacgaaaccgcgagaggagcagtatcagtcaacgtatcgcgtagtaag
cgtgttgacggtgctccatcaggattggttgaatggtaaagagtacaagtgcaaggtgtcaaacaaagcgttgccggcccctattgaaaagaccatctcaaaagcca
aggggcaaccccgagagccccaagtatacactctcccgccttcgagagaggagatgactaaaaaccaggtgtcgctttggtgtttggtgaaggggttctatccctcg
gatatcgccgtcgagtgggaatccaatgggcaacccgaaaacaactataagacaacgcctccagtactggactccgacggctcctttttcttgtactccaaattgac
ggtggataagtcgcggtggcagcaggggaatgtgttttcgtgtagcgtgatgcatgaagccctgcataaccactatactcaaaagtcactttccctgtcgggtgaat
gcggcggaggtgggtccgggggtgggggatcccaagtccagttgcaagaaagcgggccaggactcgtgaaaccctcggaaaccctgtcactgacgtgcacggtgagc
ggagggtccgtgtcgagcggagattactattggacttggattagacagtcgcccggaaaaggtctggagtggatcggacacatctactactcggggaatacgaatta
caacccgtcgttgaaatcacggctcacgattagcatcgatacctccaagacgcagttctcgctcaaacttagctccgtaactgcggccgacaccgcaatctactatt
gtgtacgcgaccgcgtcacaggggcttttgacatttggggtcagggcactatggtgacctcgtcagcgtcgacaggtggtggggggatcaggaggaggtggctccggg
ggaggcggaagcggcggtgggggctccgacatccagatgacgcagtcgccctcatcattgtcagcatcagtcggggacagggtcactattacttgtcaggccagcca
agatatctcgaactatctgaactggtatcagcagaagcctggaaaagcgcctaagctccttatctatgatgcgtccaatcttgagacaggggtgccgtcgcggtttt
ccggttcagggtcgggaacggacttcacgtttacaatctccagcctgcagccggaggacgaagccacctacttctgccaacacttcgaccatttgcctcttgcgttc
ggaggtgggacaaaggtggagatcaagcgaacttgataa
(SEQ ID NO:379)

Onartuzumab-23E-2224-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEY
KCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCKAS
GGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGG
GSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAW
DDSLNGYLFGAGTKLTVL**
(SEQ ID NO:380)

Fig. 14
(Cont'd)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggcccagcgtctttccattggcgccctcgtcgaaatcaaccagcggaggaacagctgc
gcttggttgcctcgtcaaagactacttccccgagccggtaacggtgtcgtggaactccggtgcgctgacatcaggggtgcacacgttccctgctgtccttcagtcaa
gcgggttgtactcgctctcgtccgtggtgacggtgccctccagctcgttgggcacgcagacttacatctgcaatgtgaaccataaacccagcaacactaaagtcgac
aaaaaggtcgaaccaaaatcgtgcgataagacgcacacctgcccaccttgtccggctccggaactcttgggtggtccgtccgtattcttgttcccgcctaagccgaa
ggacactcttatgatttcgaggaccccggaggtcacgtgcgtcgtggtggatgtctcgcatgaggacccggaagtcaaattcaactggtacgtagacggtgtcgagg
tgcataacgcaaagaccaagcccagggaagagcagtaccagtccacgtaccgggtagtgtcggtgctcaccgtgcttcaccaggactggcttaacgggaaggaatac
aagtgtaaagtctccaacaaagcgctccctgcccccatcgaaaagaccatttcgaaagcgaaagggcagccacgcgagcctcaagtgtacaccctgccgccgtcccg
ggaagagatgactaagaatcaggtatccctctcatgcgctgtcaagggtttctacccgtcagacatcgcagtggaatgggaatcaaacggccagccggagaataact
acaagacgacgccgcctgtcctcgattccgacggtcgttcttcctggtgtcgaagttgacagtggacaagtcgcgatggcagcaaggaaacgtcttctcatgctcg
gtaatgcacgaggcgctccataaccactatacacagaaatcgctctccttgtcaaagtcgtgcgataagacgggagggggtggatcaggtgggggaggctcgggagg
gggaggaagcggtggaggagggtcaggaggaggaggcagcgggggcggtggttccggtggtgggggatcaggcggaggcggctcatgcccgccttgtcccgcaccag
aactgcttggagggccttcggtctttctctttcccccgaaacccaaagacaccctgatgatctcacgcactcccgaagtcacatgtgtagtcgtcgatgtgtcgcat
gaagatccggaggtgaagttcaattggtacgtagatggggtcgaagtgcataatgcaaagacgaaaccgcgagaggagcagtatcagtcaacgtatcgcgtagtaag
cgtgttgacggtgctccatcaggattggttgaatggtaaagagtacaagtgcaaggtgtcaaacaaagcgttgccggcccctattgaaaagaccatctcaaaagcca
aggggcaaccccgagagccccaagtatacactctcccgccttcgagagaggagatgactaaaaaccaggtgtcgctttggtgtttggtgaaggggttctatccctcg
gatatcgccgtcgagtgggaatccaatgggcaacccgaaaacaactataagacaacgcctccagtactggactccgacggctcctttttcttgtactccaaattgac
ggtggataagtcgcggtggcagcaggggaatgtgttttcgtgtagcgtgatgcatgaagccctgcataaccactatactcaaaagtcactttccctgtcgggtgaat
gcggcggaggtgggtccgggggtggggggttcggaggtacagctcgtccagagcggcgcagaggtcaagaaaccgggatcaagcgtcaaagtgtcatgtaaagcatcg
ggtgggaccttttcatcctatgcgattggttgggtccgacaagcgcctggacaggggcttgaatggatgggtggtatcatcccgattttcggaatcgccaactacgc
acaaaagtttcaggggagagtgacaattacagccgatgagtcaacgtcctcagcctatatggaactctcatccctgcgcagcgaggacactgcggtctattactgtg
cgcgggaagaggggccctactgctcgtcgacctcgtgctacgcggcgtttgatatctggggccagggcaccctcgtgacggtatcgtccgcgtcaacaggggggtggg
ggttcgggcggaggaggatcgggaggaggtggatcgggtggtgggggatcacagtcagtcctgacgcaagacccagcggtatcggtggcccttggacagacagtaaa
gatcacgtgtcaaggggattcgttgaggtcctacttcgccagctggtatcagcagaagcccggacaggcgcccactcttgtgatgtacgcacgcaacgaccggcctg
ctggagtgcccgacagattctcggggtcgaaaagcggaacttcagcgtcgttggcaatttccggccttcagccggaggacgaggcggattactactgcgctgcctgg
gatgactcattgaatgggtatctcttcggtgcggggacgaagttgacggtgctgtgataa
(SEQ ID NO:381)

Onartuzumab-39Egy4-Cetuximab-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRISCAVS
GFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGS
GGGGSGGGGSDIVLTQSPSSLSVTPGEKVTFTCRASQSIGTNIHWYQQKPGQSPKLLIKYASESISGVPSRFSGSGSGTDFTLTINSVEAEDAATYYCQQNNNWPTT
FGQGTKLEIK**
(SEQ ID NO:382)

*Fig. 14*
(Cont'd)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggaccttccgtgttcccactggcccccctcaagcaaatctaccagtggggggaacagcagc
cctgggctgtctggtgaaggattactttccagagcccgtgaccgtcagttggaactcaggggctctgactagcggagtgcacaccttccccgcagtcctgcagtcct
ctgggctgtactccctgagttcagtggtcactgtgcccagctcctctctgggaacacagacttatatctgcaacgtgaatcacaagccttccaataccaaagtcgac
aagaaagtcgagcctaagtcatgtgataaaacccatacatgcccaagctgtcctgcaccagaatttctgggaggaccaagcgtgttcctgtttccacctaagcctaa
agacaccctgatgattagtcgcactccagaggtgacctgtgtggtcgtggacgtcagccaggaggatcccgaagtgcagtttaactggtacgtcgatggcgtggaag
tccacaatgctaagacaaaaccaagagaggaacagttcaacagcaagtacagggtcgtgtccgtgctgactgtcctgcatcaggactggctgaacggaaaagagtat
aagtgcaaagtgagcaataagggcctgcccagttcaatcgagaaaacaatttccaaggcaaaaggccagcctcgggaaccacaggtgtataccctgccacccagcag
agaggaaatgacaaagaaccaggtgtcactgagctgtgccgtcaaaggcttttaccctagcgatatcgctgtggagtgggaatccaatgggcagccagaaaacaatt
ataagaccacacctccagtgctggacagcgatggatccttctttctggtgtccaagctgaccgtggacaaatctcggtggcagcagggcaacgtgttctcctgctct
gtcatgcatgaggccctgcacaatcattacacccagaaaagtctgtcactgagcaagtcctgtgataaaacaggaggcggggggatctggcgggggaggcagtggggg
aggcgggtccggaggaggaggaagcggaggaggaggatccggaggaggcgggtctggaggcgggggaagtggaggaggaggatcttgcccaagttgtccagcacctg
agttcctgggaggaccatccgtgttcctgtttccccctaagcccaaagacaccctgatgatcagccggacacctgaagtgacttgcgtcgtggtggacgtgtcccag
gaggatccagaggtccagtttaactggtatgtcgatggcgtggaggtccacaatgctaagaccaaacctcgcgaggaacagttcaactctgactaccgagtggtcag
tgtgctgacagtcctgcatcaggattggctgaacgggaaggaatacaaatgtaaagtgagcaataagggactgccaagctccatcgagaagaccatcagcaaagcca
aaggccagcccagggaacctcaggtgtacactctgccaccctcccgcgaggaaatgaccaagaaccaggtgtctctgtggtgtctggtcaaaggattttatccctct
gacatcgccgtggagtgggaaagtaatggccagcctgaaaacaattacaagactacccctccagtgctggactcagatgggagcttctttctgtatagtaagctgac
cgtggataaatcacggtggcagcagggaaatgtgttctcttgcagtgtcatgcacgaggccctgcataaccattacacacagaagtcattaagcttatccggagagt
gtggcggcggaggaagcggaggaggcgggtctcaggtgcagctggtggagtctggaggaggagtggtgcagccaggagaatccctgaggatttcttgtgccgtgtca
ggcttcagcctgactaattacggggtgcactgggtgcgccaggctccaggcaaagggctggagtggctgggcgtgatctggtccggagggaatacagactacaacac
ccctttcacaagtaggctgaccatttcaaaggataactcaaaaagcacagtgtatttccagatgaacagcctgcgggccgaggacacagccgtgtactattgcgcca
gagctctgacttactatgattacgaattcgcctattggggacagggcactctggtgaccgtgagcagcgccagcaccggaggaggaggaagcggcggaggaggctcc
ggaggaggcgggtctggaggcgggggaagtgacatcgtgctgactcagtcaccatctagtctgagcgtgacccccggcgagaaagtgacttttacctgccgggcctc
ccagtctatcggaaccaatattcattggtatcagcagaaacccggccagtcccctaagctgctgatcaaatatgctagtgaatcaattagcggcgtgcccagccggt
tcagcgggtctggaagtggcaccgactttacactgactatcaacagtgtggaggccgaagatgccgctacatactattgtcagcagaacaataactggcctaccaca
tttgggcagggaacaaagctggagatcaagtgataa
(SEQ ID NO:383)

Onartuzumab-39Egy4-Panitumumab-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSQVQLQESGPGLVKPSETLSLTCTVS
GGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSG
GGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAF
GGGTKVEIKRT**
(SEQ ID NO:384)

*Fig. 14*
(Cont'd)

gaggtgcagttggtagaatcaggaggggtctggtccaacccggaggaagcctcagactcagctgtgcggcttcgggttacacctttacctcctattggttgcactg
ggtgagacaggcacctggcaaagggctcgaatgggtcggaatgatcgacccctccaactcagatacgcggtttaacccgaatttcaaggatcgattcacgatctcag
cagacacatcgaaaaacacagcgtacctccagatgaattcgttgagggccgaggacacggcggtgtattactgcgccacgtatcgcagctatgtaactccattggat
tactgggggcagggtactcttgtgacagtctcctcggctagcactaagggaccttccgtgttcccactggcccccctcaagcaaatctaccagtggggaacagcagc
cctgggctgtctggtgaaggattactttccagagcccgtgaccgtcagttggaactcaggggctctgactagcggagtgcacaccttccccgcagtcctgcagtcct
ctgggctgtactccctgagttcagtggtcactgtgcccagctcctctctgggaacacagacttatatctgcaacgtgaatcacaagccttccaataccaaagtcgac
aagaaagtcgagcctaagtcatgtgataaaacccatacatgcccaagctgtcctgcaccagaatttctgggaggaccaagcgtgttcctgtttccacctaagcctaa
agacaccctgatgattagtcgcactccagaggtgacctgtgtggtcgtggacgtcagccaggaggatcccgaagtgcagtttaactggtacgtcgatggcgtggaag
tccacaatgctaagacaaaaccaagagaggaacagttcaacagcaagtacagggtcgtgtccgtgctgactgtcctgcatcaggactggctgaacggaaaagagtat
aagtgcaaagtgagcaataagggcctgcccagttcaatcgagaaaacaatttccaaggcaaaaggccagcctcgggaaccacaggtgtataccctgccacccagcag
agaggaaatgacaaagaaccaggtgtcactgagctgtgccgtcaaaggcttttaccctagcgatatcgctgtggagtgggaatccaatgggcagccagaaaacaatt
ataagaccacacctccagtgctggacagcgatggatccttctttctggtgtccaagctgaccgtggacaaatctcggtggcagcagggcaacgtgttctcctgctct
gtcatgcatgaggccctgcacaatcattacacccagaaaagtctgtcactgagcaagtcctgtgataaaacaggaggcggggggatctggcggggggaggcagtggggg
aggcgggtccggaggaggaggaagcggaggaggaggatccggaggaggcgggtctggaggcggggggaagtggaggaggaggatcttgcccaagttgtccagcacctg
agttcctgggaggaccatccgtgttcctgtttccccctaagcccaaagacaccctgatgatcagccggacacctgaagtgacttgcgtcgtggtggacgtgtcccag
gaggatccagaggtccagtttaactggtatgtcgatggcgtggaggtccacaatgctaagaccaaacctcgcgaggaacagttcaactctgactaccgagtggtcag
tgtgctgacagtcctgcatcaggattggctgaacgggaaggaatacaaatgtaaagtgagcaataagggactgccaagctccatcgagaagaccatcagcaaagcca
aaggccagcccagggaacctcaggtgtacactctgccaccctcccgcgaggaaatgaccaagaaccaggtgtctctgtggtgtctggtcaaaggattttatccctct
gacatcgccgtggagtgggaaagtaatggccagcctgaaaacaattacaagactacccctccagtgctggactcagatgggagcttctttctgtatagtaagctgac
cgtggataaatcacggtggcagcagggaaatgtgttctcttgcagtgtcatgcacgaggccctgcataaccattacacacagaagtcattaagcttatccggagagt
gtggcggcggaggaagcggaggaggcgggtctcaagtccagttgcaagaaagcgggccaggactcgtgaaaccctcggaaaccctgtcactgacgtgcacggtgagc
ggagggtccgtgtcgagcggagattactattggacttggattagacagtcgcccggaaaaggtctggagtggatcggacacatctactactcggggaatacgaatta
caacccgtcgttgaaatcacggctcacgattagcatcgatacctccaagacgcagttctcgctcaaacttagctccgtaactgcggccgacaccgcaatctactatt
gtgtacgcgaccgcgtcacaggggcttttgacatttggggtcagggcactatggtgacctcgtcagcgtcgacaggtggtgggggatcaggaggaggtggctccggg
ggaggcggaagcggcggtgggggctccgacatccagatgacgcagtcgccctcatcattgtcagcatcagtcggggacagggtcactattacttgtcaggccagcca
agatatctcgaactatctgaactggtatcagcagaagcctggaaaagcgcctaagctccttatctatgatgcgtccaatcttgagacaggggtgccgtcgcggtttt
ccggttcagggtcgggaacggacttcacgtttacaatctccagcctgcagccggaggacgaagccacctacttctgccaacacttcgaccatttgcctcttgcgttc
ggaggtgggacaaaggtggagatcaagcgaacttgataa
(SEQ ID NO:385)

Onartuzumab-39Egy4-2224-HC

EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEY
KCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCS
VMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQ
EDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCKAS
GGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGG
GSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAW
DDSLNGYLFGAGTKLTVL**
(SEQ ID NO:386)

Fig. 14
(Cont'd)

ggtaccatgggcttcggactgtcgtggctttttctggtggcgattcttaaggggtccagtgcgaggtgcagttggtagaatcaggaggggtctggtccaacccgg
aggaagcctcagactcagctgtgcggcttcgggttacacctttacctcctattggttgcactgggtgagacaggcacctggcaaagggctcgaatgggtcggaatga
tcgacccctccaactcagatacgcggtttaacccgaatttcaaggatcgattcacgatctcagcagacacatcgaaaaacacagcgtacctccagatgaattcgttg
agggccgaggacacggcggtgtattactgcgccacgtatcgcagctatgtaactccattggattactgggggcagggtactcttgtgacagtctcctcggctagcac
taagggaccttccgtgttcccactggccccctcaagcaaatctaccagtggggggaacagcagccctgggctgtctggtgaaggattactttccagagcccgtgaccg
tcagttggaactcaggggctctgactagcggagtgcacaccttccccgcagtcctgcagtcctctgggctgtactccctgagttcagtggtcactgtgcccagctcc
tctctgggaacacagacttatatctgcaacgtgaatcacaagccttccaataccaaagtcgacaagaaagtcgagcctaagtcatgtgataaaacccatacatgccc
aagctgtcctgcaccagaatttctgggaggaccaagcgtgttcctgtttccacctaagcctaaagacaccctgatgattagtcgcactccagaggtgacctgtgtgg
tcgtggacgtcagccaggaggatcccgaagtgcagtttaactggtacgtcgatggcgtggaagtccacaatgctaagacaaaaccaagagaggaacagttcaacagc
aagtacagggtcgtgtccgtgctgactgtcctgcatcaggactggctgaacggaaaagagtataagtgcaaagtgagcaataagggcctgcccagttcaatcgagaa
aacaatttccaaggcaaaaggccagcctcgggaaccacaggtgtataccctgccacccagcagagaggaaatgacaaagaaccaggtgtcactgagctgtgccgtca
aaggcttttaccctagcgatatcgctgtggagtgggaatccaatgggcagccagaaaacaattataagaccacacctccagtgctggacagcgatggatccttcttt
ctggtgtccaagctgaccgtggacaaatctcggtggcagcagggcaacgtgttctcctgctctgtcatgcatgaggccctgcacaatcattacacccagaaaagtct
gtcactgagcaagtcctgtgataaaacaggaggcggggatctggcggggaggcagtgggggaggcgggtccggaggaggaggaagcggaggaggaggatccggag
gaggcgggtctggaggcgggggaagtggaggaggaggatcttgcccaagttgtccagcacctgagttcctgggaggaccatccgtgttcctgtttccccctaagccc
aaagacaccctgatgatcagccggacacctgaagtgacttgcgtcgtggtggacgtgtcccaggaggatccagaggtccagtttaactggtatgtcgatggcgtgga
ggtccacaatgctaagaccaaacctcgcgaggaacagttcaactctgactaccgagtggtcagtgtgctgacagtcctgcatcaggattggctgaacgggaaggaat
acaaatgtaaagtgagcaataagggactgccaagctccatcgagaagaccatcagcaaagccaaaggccagcccagggaacctcaggtgtacactctgccaccctcc
cgcgaggaaatgaccaagaaccaggtgtctctgtggtgtctggtcaaaggattttatccctctgacatcgccgtggagtgggaaagtaatggccagcctgaaaacaa
ttacaagactacccctccagtgctggactcagatgggagcttctttctgtatagtaagctgaccgtggataaatcacggtggcagcagggaaatgtgttctcttgca
gtgtcatgcacgaggccctgcataaccattacacacagaagtcattaagcttatccggagagtgtggcggcggaggaagcggaggaggcgggtctgaggtacagctc
gtccagagcggcgcagaggtcaagaaaccgggatcaagcgtcaaagtgtcatgtaaagcatcgggtgggaccttttcatcctatgcgattggttgggtccgacaagc
gcctggacaggggcttgaatggatgggtggtatcatcccgattttcggaatcgccaactacgcacaaaagtttcaggggagagtgacaattacagccgatgagtcaa
cgtcctcagcctatatggaactctcatccctgcgcagcgaggacactgcggtctattactgtgcgcgggaagaggggccctactgctcgtcgacctcgtgctacgcg
gcgtttgatatctggggccagggcaccctcgtgacggtatcgtccgcgtcaacaggggggtgggggttcgggcggaggaggatcgggaggaggtggatcgggtggtgg
gggatcacagtcagtcctgacgcaagacccagcggtatcggtggcccttggacagacagtaaagatcacgtgtcaaggggattcgttgaggtcctacttcgccagct
ggtatcagcagaagcccggacaggcgcccactcttgtgatgtacgcacgcaacgaccggcctgctggagtgcccgacagattctcggggtcgaaaagcggaacttca
gcgtcgttggcaatttccggccttcagccggaggacgaggcggattactactgcgctgcctgggatgactcattgaatgggtatctcttcggtgcggggacgaagtt
gacggtgctgtgataatgataatctagactcgag
(SEQ ID NO:387)

*Fig. 14*
(Cont'd)

Glycosylation mutants

Glyco mutant 1
CH2: N297D/T299S::N297D/T299S
CH3: T366S/L368A/Y407V/CH3 C-terminal Cysteine KSCDKT::T366W/CH3 C-terminal Cysteine GEC

[DKTHTCPSCPAPEFLGGPSVFLFPPKPKDTLMISRTPEVTCVVVDVSQEDPEVQFNWYVDGVEVHNAKT
KPREEQFDSSYRVVSVLTVLHQDWLNGKEYKCKVSNKGLPSSIEKTISKAKGQPREPQVYTLPPSREEMT
KNQVSLSCAVKGFYPSDIAVEWESNGQPENNYKTTPPVLDSDGSFFLVSKLTVDKSRWQQGNVFSCSVMH
EALHNHYTQKSLSLSKSCDKTGGGGSGGGGSGGGGSGGGGSGGGGSGGGGSGGGGSGGGGSCPSCPAPEF
LGGPSVFLFPPKPKDTLMISRTPEVTCVVVDVSQEDPEVQFNWYVDGVEVHNAKTKPREEQFDSSYRVVS
VLTVLHQDWLNGKEYKCKVSNKGLPSSIEKTISKAKGQPREPQVYTLPPSREEMTKNQVSLWCLVKGFYP
SDIAVEWESNGQPENNYKTTPPVLDSDGSFFLYSKLTVDKSRWQQGNVFSCSVMHEALHNHYTQKSLSLS
GEC
(SEQ ID No:388)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcgattcgagctatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggcttttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggtgggg
gctccggaggaggcggttcgggtggcggtgggtcgggtggaggcggatcgggcggtgggggaagcggtgg
tggtggaagcggagggggtggatcaggtggagggggcagctgtccatcctgccctgcaccagagtttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcgacagcagttacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaaggattctatccatcc
gatatcgcggtagagtgggaatcaaacggccagccggagaacaattacaagaccacgccccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:389)

Fig. 17

Glyco mutant 2
CH2: T299K::N297D/T299S
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFNSKYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFDSSYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:390)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcaattcgaagtatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggcttttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggtgggg
gctccggaggaggcggttcgggtggcggtgggtcgggtggaggcggatcgggcggtgggggaagcggtgg
tggtggaagcggagggggtggatcaggtggagggggcagctgtccatcctgccctgcaccagagtttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcgacagcagttacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaaggattctatccatcc
gatatcgcggtagagtgggaatcaaacggccagccggagaacaattacaagaccacgcccccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:391)

Fig. 17 (cont.)

Glyco mutant 3
CH2: N297D/T299S::T299K
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFDSSYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFNSKYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:392)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcgattcgagttatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggcttttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggtgggg
gctccggaggaggcggttcgggtggcggtgggtcgggtggaggcggatcgggcggtggggaagcggtgg
tggtggaagcggaggggggtggatcaggtggagggggcagctgtccatcctgccctgcaccagagtttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcaacagcaaatacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaaggattctatccatcc
gatatcgcggtagagtgggaatcaaacggccagccggagaacaattacaagaccacgccccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:393)

Fig. 17 (cont.)

Glyco mutant 4
CH2: T299K::T299D
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFNSKYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFNSDYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:394)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcaattcgaagtatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggcttttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggtgggg
gctccggaggaggcggttcgggtggcggtgggtcgggtggaggcggatcgggcggtgggggaagcggtgg
tggtggaagcggagggggtggatcaggtggagggggcagctgtccatcctgccctgcaccagagtttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcaacagcgattacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaggattctatccatcc
gatatcgcggtagagtgggaatcaaacggccagccggagaacaattacaagaccacgcccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:395)

Fig. 17 (cont.)

Glyco mutant 5
CH2: T299D::T299K
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFNSDYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFNSKYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:396)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcaattcggactatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggcttttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggtgggg
gctccggaggaggcggttcgggtggcggtgggtcgggtggaggcggatcgggcggtggggaagcggtgg
tggtggaagcggaggggggtggatcaggtggagggggcagctgtccatcctgccctgcaccagagttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcaacagcaaatacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaaggattctatccatcc
gatatcgcggtagagtgggaatcaaacggccagccggagaacaattacaagaccacgcccccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:397)

Fig. 17 (cont.)

Glyco mutant 6
CH2: T299D::T299D
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFNSDYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFNSDYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:398)

gataaaacgcacacgtgcccctcgtgtccggcaccggagtttcttggaggtccctcggtgttcctgttcc
ctcccaagccgaaggacacgttgatgatttcgaggacgccggaggtgacgtgtgtggtcgtagacgtgag
ccaggaggacccggaagtgcagtttaactggtacgtcgatggagtagaagtacataatgccaagacgaag
cccagggaggaacaattcaattcggattatcgcgtcgtatccgtgctgactgtgctccaccaggactggc
ttaacggaaaagaatacaagtgcaaggtatcaaataagggactcccctcgtcgatcgagaaaacaatcag
caaagcgaaaggacagccgagggaaccgcaagtgtacacattgccgccgtcgcgagaagaaatgaccaag
aaccaggtatcactctcgtgcgccgtgaagggctttacccatcggacattgctgtggagtgggagagca
acggtcaacccgagaataactacaaaactacaccgcccgtgctggattccgacggctcattctttctcgt
gtcaaaactgactgtggataagtcgcgctggcaacaggggaatgtgttctcgtgcagcgtcatgcatgaa
gctcttcataatcactacacccaaaaatccctgtcactctcgaaaagctgtgataagaccggggggtgggg
gctccggaggaggcggttcgggtggcggtgggtcgggtggaggcggatcgggcggtgggggaagcggtgg
tggtggaagcggaggggggtggatcaggtggagggggcagctgtccatcctgccctgcaccagagtttttg
ggaggaccgtccgtatttctgtttccgcccaagcccaaagatactttgatgatcagcaggacgcctgagg
taacatgtgtagtggtcgatgtctcgcaagaggaccctgaggtccagttcaattggtacgtggacggggt
ggaagtccacaacgcgaaaacgaaaccacgcgaagaacagttcaacagcgattacagagtcgtgtcagtc
ttgacagtccttcaccaggattggttgaatggaaaggagtacaagtgtaaggtgtcaaacaaaggactgc
ccagctcgatcgaaaagacaatttcgaaggcaaaaggtcaaccgcgggagccacaagtgtatacgctgcc
gccctcgcgggaggagatgacaaagaatcaggtgtcgctgtggtgtctggtaaaggattctatccatcc
gatatcgcggtagagtgggaatcaaacggccagccggagaacaattacaagaccacgccccctgtattgg
attcggacggatcgttcttcttgtattcgaaactcacggtggacaagtcgcggtggcagcagggtaatgt
gttttcatgctcagtcatgcacgaggcgctccataaccattatactcagaagtcgctgtccttgtccggg
gagtgctgataa
(SEQ ID No:399)

Fig. 17 (cont.)

Glyco wt
CH2: wt
CH3: T366S/L368A/Y407V/CH3 C-terminal Cysteine KSCDKT::T366W/CH3 C-terminal Cysteine GEC DKTHTCPSCPAPEFLGGPSVFLFPPKPKDTLMISRTPEVTCVVVDVSQEDPEVQFNWYVDGVEVHNAKTK
PREEQFNSTYRVVSVLTVLHQDWLNGKEYKCKVSNKGLPSSIEKTISKAKGQPREPQVYTLPPSREEMTK
NQVSLSCAVKGFYPSDIAVEWESNGQPENNYKTTPPVLDSDGSFFLVSKLTVDKSRWQQGNVFSCSVMHE
ALHNHYTQKSLSLSKSCDKTGGGGSGGGGSGGGGSGGGGSGGGGSGGGGSGGGGSGGGGSCPSCPAPEFL
GGPSVFLFPPKPKDTLMISRTPEVTCVVVDVSQEDPEVQFNWYVDGVEVHNAKTKPREEQFNSTYRVVSV
LTVLHQDWLNGKEYKCKVSNKGLPSSIEKTISKAKGQPREPQVYTLPPSREEMTKNQVSLWCLVKGFYPS
DIAVEWESNGQPENNYKTTPPVLDSDGSFFLYSKLTVDKSRWQQGNVFSCSVMHEALHNHYTQKSLSLSG
EC
(SEQ ID No:357)

gacaaaacccacacatgcccctcatgtccagctccagagttcctgggaggaccaagcgtgttcctgtttc
cacctaagcctaaagataccctgatgatttccaggactccagaagtgacctgcgtggtggtggacgtgtc
tcaggaggaccccgaagtgcagttcaactggtacgtggacggcgtggaggtgcacaatgccaagacaaaa
cctcgggaggaacagtttaatagcacttacagagtggtgtctgtgctgactgtgctgcatcaggattggc
tgaacggaaaggaatacaagtgcaaagtgagtaataagggcctgccatctagtatcgagaaaacaatttc
caaggctaaagggcagcctcgggaaccacaggtgtacaccctgcccccttcccgggaggaaatgactaag
aaccaggtgtcactgagctgcgccgtgaaaggcttctacccttccgacatcgctgtggagtgggaatcta
atgggcagccagaaaacaattataagaccacaccacccgtgctggactcagatgggagcttctttctggt
gtctaagctgacagtggacaaaagtagatggcagcagggcaacgtgttttcctgctctgtgatgcacgag
gccctgcacaatcattacactcagaaaagtctgtcactgagcaagtcctgtgataaaaccggcggaggag
gcagcggaggaggagggtccggaggcgggggatctggcgggggaggcagtgggggaggcgggtcaggagg
cgggggaagcggcgggggaggctccgggggaggcgggtcctgcccctcttgtcctgccccagagttcctg
ggaggcccatccgtgttcctgtttcctccaaagcccaaagacaccctgatgatctctaggacaccagaag
tgacttgcgtggtggtggacgtgagtcaggaggaccccgaagtgcagttcaactggtatgtggatggcgt
ggaggtgcacaatgctaagacaaaacctcgggaggaacagtttaatagcacttacagagtggtgtctgtg
ctgactgtgctgcatcaggattggctgaacggaaggagtataagtgcaaagtgagcaataagggactgc
catctagtatcgagaaaaccattagcaaggccaaaggccagcccagggaacctcaggtgtataccctgcc
ccctagccgcgaggaaatgacaaagaaccaggtgtccctgtggtgtctggtgaaaggattctatcccagt
gacattgctgtggagtgggaatcaaatggccagcctgaaaacaattacaagactaccccacccgtgctgg
acagtgatggctcattctttctgtattcaaagctgaccgtggataaaagcagatggcagcagggaaacgt
gttttcttgcagtgtgatgcatgaggctctgcacaatcattacacacagaagagcttaagcttaagcggc
gagtgctgataa
(SEQ ID No:358)

Fig. 17 (cont.)

| Bispecific antibody (MM131 alias) | scFv aa sequence (SEQ ID NO:) | Framework | Deamidation site removed | Methionine oxidation site removed | Orientation | Disulfide bridge | Linker |
|---|---|---|---|---|---|---|---|
| **Ab# 1** | SEQ ID NO:460 | FR 1 | yes | yes | VH/VL | yes | 1 |
| **Ab# 2** | SEQ ID NO:462 | FR 1 | yes | yes | VH/VL | no | 1 |
| **Ab# 3** | SEQ ID NO:464 | FR 1 | yes | yes | VH/VL | no | 1 |
| **Ab# 4** | SEQ ID NO:466 | FR 1 | yes | yes | VL/VH | no | 1 |
| **Ab# 5 (131-3)** | SEQ ID NO:468 | FR 2 | no | no | VL/VH | no | 1 |
| **Ab# 6** | SEQ ID NO:470 | FR 2 | yes | yes | VL/VH | no | 1 |
| **Ab# 7 (131-4)** | SEQ ID NO:472 | FR 2 | yes | yes | VL/VH | yes | 1 |
| **Ab# 8** | SEQ ID NO:474 | FR 2 | yes | no | VH/VL | no | 1 |
| **Ab# 9** | SEQ ID NO:476 | FR 3 | no | no | VH/VL | no | 1 |
| **Ab# 10** | SEQ ID NO:478 | FR 3 | yes | yes | VH/VL | no | 1 |
| **Ab# 11** | SEQ ID NO:480 | FR 3 | no | no | VL/VH | no | 1 |
| **Ab# 12** | SEQ ID NO:482 | FR 3 | yes | yes | VL/VH | no | 1 |
| **Ab# 13 (131-5)** | SEQ ID NO:484 | FR 3 | no | no | VL/VH | no | 2 |

ANTI-C-MET TANDEM FC BISPECIFIC ANTIBODIES

CROSS-REFERENCE TO RELATED APPLICATIONS

This application claims the benefit of U.S. Ser. No. 61/773,764 filed Mar. 6, 2013, and U.S. Ser. No. 61/773,788 filed Mar. 6, 2013; all of the foregoing applications are incorporated by reference in entirety.

SEQUENCE LISTING

The instant application contains a Sequence Listing which has been submitted electronically in ASCII format and is hereby incorporated by reference in its entirety. Said ASCII copy, created on May 20, 2016, is named MMJ 083 Sequence Listing.txt and is 1,401,369 bytes in size.

BACKGROUND

It has been established that tumor cells express receptors for growth factors and cytokines that stimulate proliferation of the cells and, moreover, that antibodies to such receptors (e.g., tyrosine kinase receptors) can be effective in blocking the stimulation of cell proliferation mediated by growth factors and cytokines to inhibit tumor cell growth. Commercially available therapeutic antibodies that target receptors on cancer cells include, for example, trastuzumab (Herceptin) for the treatment of breast cancer, which targets the HER2 receptor (also known as ErbB2), and cetuximab (Erbitux) for the treatment of colorectal cancer and head and neck cancer, which targets the epidermal growth factor receptor (EGFR, also known as HER1 or ErbB1).

While this approach of administering a therapeutic agent comprising only a single therapeutic monoclonal antibody (when administered in the absence of administration of another therapeutic antibody, referred to herein as monotherapy) has shown considerable success in cancer treatment, there are a number of factors that can lead to failure of such treatment or recurrence of tumor growth after initial inhibition. For example, certain tumors rely on more than one growth factor-mediated signal transduction pathway for cell proliferation and thus targeting of a single pathway may prove insufficient to significantly affect tumor cell growth. Alternatively, even in cases where one pathway is the only or predominant growth-stimulatory pathway, certain tumors cells are capable of activating another signaling pathway for growth stimulation when the original one is blocked by antibody (innate resistance to treatment). Still further, some tumors exhibit initial responsiveness to antibody monotherapy but later develop resistance to treatment by switching to use of another signaling pathway (acquired resistance to treatment). Furthermore, some receptors, such as a c-Met receptor, are stimulated by conventional antibodies (e.g., IgG antibodies) to transduce signals into a cell upon which they are expressed. Without intending to be bound by any particular theory of operation, this phenomenon is believed to result from the crosslink pairing of two receptors on the same cell by the paired, generally identical, antigen binding sites present on antibodies such as IgAs, IgDs, IgEs, IgGs and IgMs. Such stimulation may have the opposite effect to that which produces a therapeutic benefit—e.g., cell growth and replication may be upregulated by such anti-c-Met antibodies, rather than inhibited.

In embodiments, the interaction with a receptor or plurality of receptors (e.g., a c-Met receptor) and a composition of the invention results in an antagonist activity. In a particular embodiment, such interaction results in an antagonist activity and is substantially free or free of agonist activity. In an aspect, antagonist activity is useful for compositions and methods of inhibiting cancer.

Accordingly, additional therapeutic approaches for cancer treatment are needed to overcome limitations of antibody monotherapy and to provide other benefits.

SUMMARY

Provided herein are engineered antibodies, such as Tandem Fc Antibodies ("TFcAs"). Exemplary TFcAs are Tandem Fc Bispecific Antibodies (TFcBAs) such as those described in U.S. Provisional Application No. 61/527,802, filed Aug. 26, 2011; and copending PCT International Application No. PCT/US2012/052490, filed Aug. 27, 2012 (see Int'l Pub. No. WO2013/033008A2). A TFcBA comprises a Tandem Fc, which is a polypeptide moiety that comprises a first Fc region and a second Fc region, each of said first Fc region and second Fc region having a C-terminus and an N-terminus; the first Fc region and the second Fc region are linked as a single polypeptide chain through a TFc linker having a C-terminus and an N-terminus (i.e., the C-terminus of the first Fc region is linked by a peptide bond to the N-terminus of the TFc linker, the C-terminus of which TFc linker is in turn linked by a peptide bond to the N-terminus of the second Fc region). A TFcBA may comprise at least two binding sites (at least a first binding site and a second binding site). Each such binding site binds specifically to a specific part of a cell surface receptor. Exemplary cell surface receptors are those that are expressed or overexpressed by cancer cells. Exemplary binding sites include antibody-derived binding sites that bind immunospecifically to an extracellular domain of a cell surface receptor. The first or the second binding site of a TFcA or TFcBA may bind specifically to a human receptor protein selected from the group consisting of ErbB2, ErbB3 (e.g., a binding site described in U.S. Pat. No. 7,846,440), ErbB4, IGF1R, IGF2R, Insulin receptor, RON, c-Met, EGFR, VEGFR1, VEGFR2, TNFR, FGFR1-4, PDGFR (alpha and beta), c-Kit, EPCAM and EphA2. Generally, the receptor will be a receptor tyrosine kinase. Typically such binding will be specific to the extracellular portion of the receptor protein. In certain embodiments disclosed herein, one of the at least two binding sites comprised by a TFcBA is a binding site specific to c-Met, e.g., an anti-c-Met Fab or an anti-cMet scFv. In certain exemplified embodiments a TFcBA is provided that comprises a single anti-c-Met binding site and at least one second binding site that does not bind to c-Met, e.g., a binding site specific to ErbB2, ErbB3, ErbB4, IGF1R, IGF2R, Insulin receptor, RON, EGFR, VEGFR1, VEGFR2, TNFR, FGFR1-4, PDGFR (alpha and beta), c-Kit, EPCAM and EphA2, wherein the anti-c-Met binding site and the second binding site are linked through a TFc to form a contiguous polypeptide. TFcBAs are provided that bind to two epitopes (e.g., extracellular epitopes) on a single receptor or to two distinct cell surface receptors and which, upon such binding, strongly inhibit signal transduction that is normally stimulated by a cognate ligand of at least one cell surface receptor to which the TFcBA binds. For example, an anti-c-Met+anti-EGFR TFcBA may inhibit signal transduction induced by either or both of HGF (hepatocyte growth factor, the cognate ligand of C-met) and EGF (epidermal growth factor, the cognate ligand of EGFR), or an anti-c-Kit+anti-RON TFcBA may inhibit signal transduction induced by either or both of Macrophage Stimulating Protein (the cognate ligand of RON) and Stem Cell Factor (the cognate ligand of c-Kit), or an anti-c-Met+anti-EPCAM TFcBA may inhibit signal transduction induced by HGF and may inhibit signaling by the c-Met receptor in the absence of HGF (e.g., ligand-independent c-Met signaling); each such inhibition being with an $IC_{50}$ of 10 nM or less or 1 nM or less or 100 pM or less, or with a maximal percent inhibition of at least 70% or at least 80% or at least 90%, as indicated by inhibition of ligand-induced (or in the case of c-Met signaling in the absence of HGF, ligand-independent) phosphorylation of the receptor(s) that are signal transduction inhibited by the TFcBA. In many embodiments, anti-c-Met comprising TFcBAs provided herein produce essentially no stimulatory effect on cells expressing c-Met. In other embodiments, anti-c-Met comprising TFcBAs provided herein induce downregulation or degradation of c-Met receptors on cells expressing c-Met. In other embodiments, anti-EPCAM TFcBAs herein provided produce most (e.g., 60%, 70%, 80%, 90% or greater than 95%) of their signaling inhibition effects in cells expressing low EPCAM levels (as few as 100,000+/−5% EPCAM molecules per cell) or very low EPCAM levels (as few as 24,000+/−5% EPCAM molecules per cell). In certain embodiments, expression of the TFcBA in a cell produces (i) more (i.e. a greater percentage of) correctly formed TFcAB molecules relative to the expression of a multivalent antibody that binds to the same receptor(s) but does not comprise a TFc or (ii) more than 80% of correctly formed TFcAB molecules as determined, e.g., by Size Exclusion Chromatography (SEC).

Also provided herein are Abs which are TFcBAs, wherein the TFcBAs comprise a first binding site and a second binding site, wherein the first binding site binds to a first target and the second binding site binds to a second target, and wherein (i) the first and the second binding sites are linked through a TFc; (ii) the TFc comprises a first Fc region and a second Fc region, each said first Fc region and second Fc region having a C-terminus and an N-terminus; (iii) the first Fc region and the second Fc region are linked through a TFc linker having a C-terminus and an N-terminus to form a contiguous polypeptide; (iv) the first and the second Fc regions associate (bind) to form an Fc dimer; and (v) either or both of the first and the second Fc region comprise one or more amino acid (aa) modification to enhance or stabilize the binding between the first and the second Fc region. The TFcBA may inhibit signal transduction through either or both of the first and the second target. In certain embodiments, expression of the TFcBA in a host cell produces (i) more correctly formed TFcAB molecules relative to the expression in a matched host cell of a multivalent antibody that binds to the same receptor(s) but does not comprise a TFc or (ii) more than 80% of correctly formed TFcBA molecules as determined, e.g., by SEC.

Further provided herein are monovalent tandem FC antibodies (TFcAs). A monovalent TFcA may comprise a single binding site that binds to a target, wherein the binding site is linked to a TFc comprising a first Fc region and a second Fc region, each said first Fc region and second Fc region having a C-terminus and an N-terminus; and wherein (i) the first Fc region and the second Fc region are linked through a TFc linker having a C-terminus and an N-terminus to form a contiguous polypeptide; (ii) the first and the second Fc regions associate to form an Fc dimer; and (iii) either or both of the first and the second Fc region comprise one or more aa modification to enhance or stabilize the binding between the first and the second Fc region. The monovalent TFcA may inhibit signal transduction through the target. In certain embodiments, expression of the monovalent TFcA in a host cell produces (i) more correctly formed TFcA molecules relative to the expression in a matched host cell of an antibody that does not comprise a TFc or (ii) more than 80% of correctly formed TFcA molecules as determined, e.g., by SEC.

The first Fc region and the second Fc region of a TFc comprised by a TFcA, such as a TFcBA, may comprise a first and a second CH3 domain, respectively, each said CH3 domain having a C-terminus and an N-terminus. The first and the second Fc regions of a TFc comprised by a TFcA may comprise a first and a second CH2 domain, respectively, each said CH2 domain having a C-terminus and an N-terminus. The first and the second Fc regions of a TFc comprised by a TFcA may comprise a first and a second hinge, respectively, each said first hinge and said second hinge having a C-terminus and an N-terminus. In certain embodiments, the second hinge does not comprise an upper hinge subdomain. The TFc comprised in the TFcA may comprise in amino to carboxyl terminal order: a first CH2 domain, a first CH3 domain, a TFc linker, a second CH2 domain and a second CH3 domain. The TFc comprised in the TFcA may comprise in amino to carboxyl terminal order: a first hinge, a first CH2 domain, a first CH3 domain, a TFc linker, a second CH2 domain and a second CH3 domain. The TFc comprised in the TFcA may comprise in amino to carboxyl terminal order: a first hinge, a first CH2 domain, a first CH3 domain, a TFc linker, a second hinge, a second CH2 domain and a second CH3 domain. The first hinge may comprise an upper hinge subdomain, a core hinge subdomain and a lower hinge subdomain and the second hinge may comprise a core hinge subdomain and a lower hinge subdomain, but not an upper hinge subdomain, each said hinge sub-domain having a C-terminus and an N-terminus. The TFc comprised by the TFcA may comprise in amino to carboxyl terminal order: a first hinge, which is linked at its C-terminus to the N-terminus of a first CH2 domain, which is linked at its C-terminus to the N-terminus of a first CH3 domain, which is linked at its C-terminus to the N-terminus of a TFc linker, which is linked at its C-terminus to the N-terminus of a second hinge, which is linked at its C-terminus to the N-terminus of a second CH2 domain, which is linked at its C-terminus to the N-terminus of a second CH3 domain.

A TFc linker of a TFc comprised by a TFcA may comprise 20-50 aas. A TFc linker may be a Gly-Ser linker, such as $(Gly_4Ser)_n$, wherein n is 4, 5, 6, 7 or 8 (SEQ ID NO: 490). A TFc linker may also comprise an aa sequence that is at least about 70%, 80%, 90%, 95%, 97%, 98%, or 99% identical to an aa sequence of a Gly-Ser linker or which differs therefrom in at most 20, 15, 10, 5, 4, 3, 2, or 1 aa addition, deletion or substitution.

A TFc of a TFcA may be an IgG1 TFc. A TFc may be a hybrid TFc, e.g., an IgG1/IgG4 hybrid TFc. A TFc of a TFcA may be an IgG1 TFc and may comprise in amino to carboxyl terminal order: a first IgG1 hinge, a first IgG1 CH2 domain, a first IgG1 CH3 domain, a TFc linker, a second IgG1 hinge, a second IgG1 CH2 domain, and a second IgG1 CH3 domain. A hybrid TFc may comprise in amino to carboxyl terminal order: a first IgG1/IgG4 hinge, a first IgG4 CH2 domain, a first IgG1 CH3 domain, a TFc linker, a second IgG4 hinge, a second IgG4 CH2 domain, and a second IgG1 CH3 domain.

Either or both of the first CH3 domain and the second CH3 domain of a TFc may comprise one or more aa modifications that enhance or stabilize the binding between the first and the second Fc regions, as evidenced, e.g., by an essentially uniform product (or band) on a non-denaturing SDS-Page gel. Each of the first CH3 domain and the second CH3 domain of a TFc may comprise an amino acid modification, which modification is an Association Enhancing Modification ("AEM") that enhances the association of the first CH3 domain with the second CH3 domain. An AEM may be comprised by a module selected from the group consisting of AEM module 1, AEM module 2, AEM module 3 and AEM module 4. Either or both of the first Fc region and the second Fc region of a TFc may comprise an aa modification that adds a cysteine as an insertion or replacement, which cysteine forms a disulfide bond with a cysteine in the other Fc region (a "DiS" modification). Either or both of the first and the second Fc region of a TFc may comprise a DiS modification in a hinge. In certain embodiments, either or both of the first and the second Fc region comprise a DiS modification in a CH3 domain. The DiS modification may be comprised by DiS module 1 or DiS module 2. Each of the first CH3 domain and the second CH3 domain of a TFc may comprise one or more AEM modifications and one or more DiS modifications.

Either or both of the first and the second CH3 domains of a TFc may comprise an aa sequence that is at least 70%, 80%, 90%, 95%, 97%, 98%, or 99% identical to an aa sequence of a CH3 domain provided herein, e.g., selected from the group consisting of SEQ ID NOs:27-98, or which differs therefrom in at most 30, 25, 20, 15, 10, 5, 4, 3, 2, or 1 aa additions, deletions or substitutions. In certain embodiments, if the aa sequence of a CH3 domain is not identical to a sequence selected from the group of sequences SEQ ID NOs:27-98, then the aa sequence of the CH3 domain nevertheless comprises the particular AEM and/or DiS of the sequence to which it is similar. The first CH3 domain or the second CH3 domain of a TFc may comprises an aa sequence provided herein, e.g., selected from the group consisting of SEQ ID NOs:27-98. The first CH3 and second CH3 domains of a TFc together may comprise a pair of two different members, each member being a CH3 aa sequence, each pair selected from the group of pairs consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, each member aa sequence being at least 70%, 80%, 90%, 95%, 97%, 98%, or 99% identical to, or differing in at most 30, 25, 20, 15, 10, 5, 4, 3, 2, or 1 aa additions, deletions or substitutions from the each sequence of each said pair, wherein the first CH3 domain comprises a different member of the pair than is comprised by the second CH3 domain. The first and the second CH3 domains of a TFc may each comprise an aa sequence that identical to an aa sequence of a member of the pair of CH3 aa sequences selected from the group consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98.

The first hinge of a TFc may comprise an aa sequence that differs in at most 3, 2 or 1 aa deletions, additions or substitutions from an aa sequence of a hinge provided herein, e.g., selected from the group consisting of SEQ ID NOs:4, 18, 19, 20, 21, 22, 263-265 and 267-273. The first hinge of a TFc may comprise an aa sequence that is an aa sequence selected from the group consisting of SEQ ID NOs:4, 18, 19, 20, 21, 22, 263-265 and 267-273. The second hinge of a TFc may comprise an aa sequence that differs in at most 3, 2 or 1 aa deletions, additions or substitutions from an aa sequence of a hinge provided herein, e.g., selected from the group consisting of SEQ ID NOs:23, 24, 263-265 and 267-273. The second hinge may comprise an aa sequence that is an aa sequence selected from the group consisting of SEQ ID NOs:23, 24, 263-265 and 267-273.

A CH2 domain of a TFc may comprise an aa sequence that is at least 70%, 80%, 90%, 95%, 97%, 98%, or 99% identical to an aa sequence of a CH2 domain provided herein, e.g., SEQ ID NO:25, 26, 261 or 262, or which differs therefrom in at most 30, 25, 20, 15, 10, 5, 4, 3, 2, or 1 aa deletions, additions or substitutions.

The TFc may comprise in amino to carboxyl terminal order: a first hinge, a first CH2 domain, a first CH3 domain, a second hinge, a second CH2 domain and a second CH3 domain, wherein (i) the first hinge comprises an aa sequence selected from the group consisting of SEQ ID NOs:4, 18, 19, 263-265 and 267-273; (ii) the first CH2 domain is aglycosylated and comprises the aa sequence set forth as SEQ ID NO:25; (iii) the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98; (iv) the second hinge comprises an aa sequence consisting of a sequence selected from the group consisting of SEQ ID NO:23, 263-265 and 267-273; (v) the second CH2 domain is aglycosylated and comprises the aa sequence set forth in SEQ ID NO:25; and (vi) the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

A TFc may comprise in amino to carboxyl terminal order: a first hinge, a first CH2 domain, a first CH3 domain, a second hinge, a second CH2 domain and a second CH3 domain, wherein (i) the first hinge comprises an aa sequence selected from the group consisting of SEQ ID NOs:20, 21, 22, 263-265 and 267-273; (ii) the first CH2 domain is aglycosylated and comprises the aa sequence set forth in SEQ ID NO:26; (iii) the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98; (iv) the second hinge comprises an aa sequence consisting of SEQ ID NO:24, 263-265 and 267-273; (v) the second CH2 domain is aglycosylated and comprises the aa sequence set forth in SEQ ID NO:26; and (vi) the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

The first or the second Fc region of a TFc may comprise an aa sequence that is at least 70%, 80%, 90%, 95%, 97%, 98%, or 99% identical to an aa sequence of an Fc region provided herein, e.g., selected from the group consisting of SEQ ID NOs:99-166, or differs therefrom in at most 50, 40, 30, 25, 20, 15, 10, 5, 4, 3, 2, or 1 aa deletions, additions or substitutions. The first or the second Fc region comprises an aa sequence selected from the group consisting of SEQ ID NOs:99-166. The first and the second Fc region may comprise an aa sequence that is at least 70%, 80%, 90%, 95%, 97%, 98%, or 99% identical to one aa sequence of a pair of aa sequences selected from the group consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:163 and 164; and SEQ ID NOs:165 and 166, or which differs therefrom in at most 50, 40, 30, 25, 20, 15, 10, 5, 4, 3, 2, or 1 aa deletions, additions or substitutions, and wherein the first Fc region comprises a different member of the pair than is comprised by the second Fc region. The first Fc region and the second Fc region together may comprise a pair of two different members, each member being an Fc aa sequence, wherein each pair is selected from the group of pairs consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:163 and 164; and SEQ ID NOs:165 and 166, each member aa sequence being at least 70%, 80%, 90%, 95%, 97%, 98%, or 99% identical to, or differing in at most 50, 40, 30, 25, 20, 15, 10, 5, 4, 3, 2, or 1 aa additions, deletions or substitutions from each sequence of each said pair, wherein the first Fc region comprises a different member of the pair than is comprised by the second Fc region.

A TFc may comprise an aa sequence that is at least 70%, 80%, 90%, 95%, 97%, 98%, or 99% identical to an aa sequence of a TFc provided herein, e.g., selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221, or which differs therefrom in at most 30, 25, 20, 15, 10, 5, 4, 3, 2, or 1 aa additions, deletions or substitutions. The TFc may comprise an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221.

A TFcA, e.g., a TFcBA, e.g., an anti-c-Met+anti-EGFR TFcBA or an anti-c-Kit+anti-RON TFcBA or an anti-FGFR2+ anti-EPCAM TFcBA, may comprise a heavy chain that comprises in amino to carboxyl terminal order: a first heavy chain variable (VH) domain, a TFc, a connecting linker and a second VH domain. The heavy chain may comprise in amino to carboxyl terminal order: a first VH domain, a CH1 domain, a TFc, a connecting linker and a second VH domain. The heavy chain may comprise in amino to carboxyl terminal order: a first VH domain, a CH1 domain, a TFc, a connecting linker, a second VH domain, an scFv linker and a second light chain variable (VL) domain, wherein the second VH and VL domains associate to form a second binding site. A TFcA may comprise a light chain that comprises a first VL domain that dimerizes with the first VH domain to form a first binding site. The light chain may comprise a light chain constant (CL) domain that is linked to the carboxyl terminus of the VL domain. The first binding site may be an anti-c-Met, anti-c-Kit, anti-ErbB2, anti-ErbB3, anti-ErbB4, anti-IGF1R, anti-IGF2R, anti-Insulin receptor, anti-RON, anti-EGFR, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EPCAM or anti-EphA2 binding site and the second binding site may be an anti-c-Met, anti-c-Kit, anti-ErbB2, anti-ErbB3, anti-ErbB4, anti-IGF1R, anti-IGF2R, anti-Insulin receptor, anti-RON, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EphA2 or anti-EGFR binding site. If a TFcA is a monovalent TFcA, the binding site may be an anti-c-Met, anti-c-Kit, anti-ErbB2, anti-ErbB3, anti-ErbB4, anti-IGF1R, anti-IGF2R, anti-Insulin receptor, anti-RON, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EPCAM, anti-EphA2 or anti-EGFR binding site. An exemplary anti-c-Met binding site may comprise a VH domain comprising either or both of a) the aa sequence of the VH Complementarity Determining Region (CDR)3 (VHCDR3) in SEQ ID NO:223 or 287 and b) a VLCDR3 comprising the aa sequence of the VLCDR3 in SEQ ID NO:231 or 289. Another exemplary the anti-c-Met binding site may comprise a VH domain comprising a set of three VH CDRs comprising VHCDR1, VCDR2 and VHCDR3, wherein VHCDR1, VHCDR2 and VHCDR3 comprise the aa sequence of the VHCDR1, VHCDR2 and VHCDR3 in SEQ ID NO:223 or 231; and a VL domain comprising a set of three VLCDRs comprising VLCDR1, VLCDR2, and VLCDR3, wherein VLCDR1, VLCDR2 and VLCDR3 comprise the aa sequence of the VLCDR1, VLCDR2 and VLCDR3 in SEQ ID NO:287 or 289, respectively. An exemplary anti-EGFR binding site may comprise either or both of a) a VHCDR3 comprising the aa sequence of the VHCDR3 in SEQ ID NO:233, 237, 258, 275, 277 or 279 and b) a VLCDR3 comprising the aa sequence of the VLCDR3 in SEQ ID NO:233, 237, 258, 275, 277 or 279. An exemplary anti-EGFR binding site may comprise a VH domain comprising a set of three VHCDRs comprising VHCDR1, VCDR2 and VHCDR3, wherein VHCDR1, VHCDR2 and VHCDR3 comprise the aa sequence of the VHCDR1, VHCDR2 and VHCDR3 in SEQ ID NO: 233, 237, 258, 275, 277 or 279; and a VL domain comprising a set of three VLCDRs comprising VLCDR1, VLCDR2, and VLCDR3, wherein VLCDR1, VLCDR2 and VLCDR3 comprise the aa sequence of the VLCDR1, VLCDR2 and VLCDR3 in SEQ ID NO:233, 237, 258, 275, 277 or 279. The anti-c-Met, anti-c-Kit, anti-ErbB2, anti-ErbB3, anti-ErbB4, anti-IGF1R, anti-IGF2R, anti-Insulin receptor, anti-RON, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EPCAM, anti-EphA2 or anti-EGFR binding site may comprise an N-terminal portion of the heavy chain and an N-terminal portion of the light chain. The anti-EGFR, anti-c-Kit, anti-ErbB2, anti-ErbB3, anti-ErbB4, anti-IGF1R, anti-IGF2R, anti-Insulin receptor, anti-RON, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EPCAM, anti-EphA2 or anti-c-Met binding site may be comprised by a C-terminal scFv that is entirely comprised by the heavy chain to form a contiguous polypeptide.

An anti-c-Met binding site of a TFcA, e.g., a TFcBA, may be comprised by either or both of a VH domain and a VL domain, wherein the VH domain comprises an aa sequence that is at least 70%, 80%, 90%, 95%, 97%, 98%, or 99% identical to the VH domain of an anti-c-Met binding site, e.g., set forth in SEQ ID NOs:223, 231, 287 or 289, or differs therefrom in at most 10, 9, 8, 7, 6, 5, 4, 3, 2, or 1 aas deletions, additions or substitution; and the VL domain comprises an aa sequence that is at least 70%, 80%, 90%, 95%, 97%, 98%, or 99% identical to the VL domain of an anti-c-Met binding site provided herein, e.g., set forth in SEQ ID NOs:223, 231, 287 or 289, or differs therefrom in at most 10, 9, 8, 7, 6, 5, 4, 3, 2, or 1 aas deletions, additions or substitution.

An anti-EGFR binding site of a TFcA, e.g., a TFcBA, may be comprised by either or both of a VH domain and a VL domain, wherein the VH domain comprises an aa sequence that is at least 70%, 80%, 90%, 95%, 97%, 98%, or 99% identical to the VH domain of an anti-EGFR binding site provided herein, e.g., set forth in SEQ ID NOs: 233, 237, 258, 275, 277 or 279, or differs therefrom in at most 10, 9, 8, 7, 6, 5, 4, 3, 2, or 1 aa(s) deletion(s), addition(s) or substitution(s); and the VL domain comprises an aa sequence that is at least 70%, 80%, 90%, 95%, 97%, 98%, or 99% identical to the VL domain of an anti-EGFR binding site provided herein, e.g., set forth in SEQ ID NOs: 233, 237, 258, 275, 277 or 279, or differs therefrom in at most 10, 9, 8, 7, 6, 5, 4, 3, 2, or 1 aa(s) deletion(s), addition(s) or substitution(s).

A TFcA or TFcBA may be a charge-complementary paired TFcA or TFcBA, e.g., wherein: a charge-complementary paired TFcA or TFcBA is a TFcA or TFcBA that comprises a pair of charged amino acids comprising an amino acid selected from group A and an amino acid selected from group B (a charge-complementary pair); wherein group A comprises all natural amino acids with a pI of greater than 7 and group B comprises all natural amino acids with a pI of less than 7, or optionally wherein group A comprises H is, Lys, and Arg, and group B comprises Asp, Glu, Asn, Phe, Gln, Tyr, Ser, Met, Thr, Ile, Gly, Val, Trp, Leu, Ala, and Pro; and said charge-complementary pair consists of a first amino acid residue and a second amino acid residue, and said charge-complementary pair is a position 297 charge-complementary pair or a position 299 charge-complementary pair, wherein a position 297 charge-complementary pair is a charge-complementary pair with said first amino acid residue located at EU position 297 of said first Fc region and said second amino acid residue located at EU position 297 of said second Fc region, and a position 299 charge-complementary pair is a charge-complementary pair with said first amino acid residue located at EU position 299 of said first Fc region and said second amino acid residue located at EU position 299 of said second Fc region. The charge-complementary paired TFcA or TFcBA may comprise both a position 297 charge-complementary pair and a position 299 charge-complementary pair, wherein the first and second amino acid residues of the position 297 charge-complementary pair are the same as or different from the first and second amino acid residues of the position 299 charge-complementary pair. The charge-complementary paired TFcA or may comprise a position 297 charge-complementary pair and wherein the charge-complementary paired TFcA or TFcBA is more stable than a TFcA or TFcBA that is not a charge-complementary paired TFcA or TFcBA but that is identical to the charge-complementary paired TFcA or TFcBA except that amino acid residues corresponding to the first and the second amino acid residues are both residues consisting of the same charged amino acid, said same charged amino acid being one of the amino acids of the position 297 charge-complementary pair of the charge-complementary paired TFcA or TFcBA. The charge-complementary paired TFcA or TFcBA may comprise a position 299 charge-complementary pair and wherein the charge-complementary paired TFcA or TFcBA is more stable than a TFcA or TFcBA that is not a charge-complementary paired TFcA or TFcBA but that is identical to the charge-complementary paired TFcA or TFcBA except that amino acid residues corresponding to the first and the second amino acid residues are both residues consisting of the same charged amino acid, said same charged amino acid being one of the amino acids of the position 299 charge-complementary pair of the charge-complementary paired TFcA or TFcBA.

The first or the second binding site of a TFcA or TFcBA may bind specifically to a human receptor protein selected from the group consisting of ErbB2, ErbB3, ErbB4, IGF1R, IGF2R, Insulin receptor, RON, c-Met, EGFR, VEGFR1, VEGFR2, TNFR, FGFR1-4, PDGFR (alpha and beta), c-Kit, EPCAM and EphA2.

Further provided herein are pharmaceutical compositions comprising a TFcA or TFcBA and a pharmaceutically acceptable carrier. Also provided are nucleic acid molecules, e.g., comprising at least one coding sequence, said at least one coding sequence encoding a heavy chain or a light chain of a TFcA or TFcBA. A nucleic acid molecule may comprise at least two coding sequences, wherein one coding sequence encodes a heavy chain of a TFcA or TFcBA and a second coding sequence encodes a light chain of the TFcBA. Also provided are vectors, e.g., comprising one or more nucleic acid molecules provided herein. Further provided are cells, e.g., host cells or isolated cells, comprising one or more vectors and/or nucleic acid molecules provided herein. A cell may comprise a nucleic acid molecule encoding the heavy chain of a TFcA or TFcBA and a nucleic acid molecule encoding the light chain of the TFcA or TFcBA.

Also encompassed herein are methods of producing a TFcA or TFcBA comprising culturing a host cell described herein under conditions in which the nucleic acids are expressed, and isolating the TFcA or TFcBA. A method for producing a TFcA or TFcBA may comprise culturing a cell described herein under conditions suitable for the expression of the TFcA or TFcBA.

Also provided herein are methods of treating a subject having cancer, said method comprising administering to a subject a therapeutically effective amount of a TFcA or TFcBA, nucleic acid molecule, or vector described herein.

Exemplary embodiments include but are not limited to the following items in connection with the subject matter which may be claimed.

1. An antibody, which is a Tandem Fc Bispecific Antibody ("TFcBA"), wherein the TFcBA comprises a first binding site that is a single anti-c-Met binding site and at least one second binding site that specifically binds to a cell surface receptor other than c-Met; optionally a cell surface receptor selected from ErbB2, ErbB3, ErbB4, IGF1R, IGF2R, Insulin receptor, RON, EGFR, VEGFR1, VEGFR2, TNFR, FGFR1, FGFR2, FGFR3, FGFR4, PDGFR alpha, PDGFR beta, c-Kit, AXL, ALK, CEA, CD44, EPCAM and EphA2, wherein the anti-c-Met binding site and the second binding site are linked through a Tandem Fc ("TFc"); the TFc comprises a first Fc region and a second Fc region, each said first Fc region and second Fc region having a C-terminus and an N-terminus; the first Fc region and the second Fc region are linked through a TFc linker having a C-terminus and an N-terminus to form a contiguous polypeptide; and the first and the second Fc regions associate to form an Fc dimer.
2. The TFcBA of embodiment 1, wherein
   a. the TFcBA inhibits signal transduction induced by either or both of HGF and a cognate ligand of the receptor specifically bound by the at least one second binding site with an IC50 of 10 nM or less or 1 nM or less or 100 μM or less, or a maximal percent inhibition of at least 70% or at least 80% or at least 90%, as indicated by inhibition of phosphorylation of either or both of c-Met and the receptor specifically bound by the at least one second binding site; or
   b. expression of the TFcBA in a cell produces (i) more correctly formed TFcAB molecules relative to the expression of a multivalent antibody that does not comprise a TFc or (ii) more than 80% of correctly formed TFcAB molecules as determined by Size Exclusion Chromatography (SEC).
3. The TFcBA of embodiment 1 or 2, wherein the first Fc region and the second Fc region comprise a first and a second CH3 domain, respectively, each said CH3 domain having a C-terminus and an N-terminus.
4. The TFcBA of anyone of embodiments 1-3, wherein the first and the second Fc regions comprise a first and a second CH2 domain, respectively, each said CH2 domain having a C-terminus and an N-terminus.
5. The TFcBA of anyone of embodiments 1-4, wherein the first and the second Fc regions comprise a first and a second hinge, respectively, each said first hinge and said second hinge having a C-terminus and an N-terminus.
6. The TFcBA of any one of embodiments 1-5, wherein the second hinge does not comprise an upper hinge subdomain.
7. The TFcBA of embodiment 6, wherein the TFc comprised in the TFcBA comprises in amino to carboxyl terminal order: a first CH2 domain, a first CH3 domain, a TFc linker, a second CH2 domain and a second CH3 domain.
8. The TFcBA of embodiment 6, wherein the TFc comprised in the TFcBA comprises in amino to carboxyl terminal order: a first hinge, a first CH2 domain, a first CH3 domain, a TFc linker, a second CH2 domain and a second CH3 domain.
9. The TFcBA of embodiment 6, wherein the TFc comprised in the TFcBA comprises in amino to carboxyl terminal order: a first hinge, a first CH2 domain, a first CH3 domain, a TFc linker, a second hinge, a second CH2 domain and a second CH3 domain.
10. The TFcBA of embodiment 9, wherein the first hinge comprises an upper hinge subdomain, a core hinge subdomain and a lower hinge subdomain and the second hinge comprises a core hinge subdomain and a lower hinge subdomain, but not an upper hinge subdomain, each said hinge sub-domain having a C-terminus and an N-terminus.
11. A TFcBA of any one of embodiments 1-10, wherein the TFc comprised by the TFcBA comprises in amino to carboxyl terminal order: a first hinge, which is linked at its C-terminus to the N-terminus of a first CH2 domain, which is linked at its C-terminus to the N-terminus of a first CH3 domain, which is linked at its C-terminus to the N-terminus of a TFc linker, which is linked at its C-terminus to the N-terminus of a second hinge, which is linked at its C-terminus to the N-terminus of a second CH2 domain, which is linked at its C-terminus to the N-terminus of a second CH3 domain.
12. The TFcBA of any one of embodiments 1-11, wherein the TFc linker comprises 20-50 aas.
13. The TFcBA of embodiment 12, wherein the TFc linker is a Gly-Ser linker
14. The TFcBA of embodiment 13, wherein the TFc linker comprises $(Gly_4Ser)_n$, wherein n is 4, 5, 6, 7 or 8 (SEQ ID NO: 490).
15. The TFcBA of any one of embodiments 1-14, wherein the TFc is an IgG1 TFc.
16. The TFcBA of any of embodiments 1-14, wherein the TFc is a hybrid TFc.

17. The TFcBA of embodiment 16, wherein the TFc is an IgG1/IgG4 TFc.
18. The TFcBA of embodiment 15, wherein the TFc comprises in amino to carboxyl terminal order: a first IgG1 hinge, a first IgG1 CH2 domain, a first IgG1 CH3 domain, a TFc linker, a second IgG1 hinge, a second IgG1 CH2 domain, and a second IgG1 CH3 domain.
19. The TFcBA of embodiment 17, wherein the hybrid TFc comprises in amino to carboxyl terminal order: a first IgG1/IgG4 hinge, a first IgG4 CH2 domain, a first IgG1 CH3 domain, a TFc linker, a second IgG4 hinge, a second IgG4 CH2 domain, and a second IgG1 CH3 domain.
20. The TFcBA of anyone of embodiments 1-19, wherein either or both of the first CH3 domain and the second CH3 domain comprise one or more aa modifications that enhance or stabilize the binding between the first and the second Fc regions.
21. The TFcBA of embodiment 20, wherein each of the first CH3 domain and the second CH3 domain comprises an amino acid modification, which modification is an Association Enhancing Modification ("AEM") that enhances the association of the first CH3 domain with the second CH3 domain.
22. The TFcBA of embodiment 21, wherein the AEM is comprised by a module selected from the group consisting of AEM module 1, AEM module 2, AEM module 3 and AEM module 4.
23. The TFcBA of anyone of embodiments 1-22, wherein either or both of the first Fc region and the second Fc region comprises an aa modification that adds a cysteine as an insertion or replacement, which cysteine forms a disulfide bond with a cysteine in the other Fc region (a "DiS" modification).
24. The TFcBA of embodiment 23, wherein either or both of the first and the second Fc region comprise a DiS modification in a hinge.
25. The TFcBA of embodiment 23, wherein either or both of the first and the second Fc region comprise a DiS modification in a CH3 domain.
26. The TFcBA of any one of embodiments 23-25, wherein the DiS modification is comprised by DiS module 1 or DiS module 2.
27. The TFcBA of any one of embodiments 1-26, wherein each of the first CH3 domain and the second CH3 domain comprises one or more AEM modifications and one or more DiS modifications.
28. The TFcBA of any one of embodiments 1-27, wherein either or both of the first and the second CH3 domains comprises an aa sequence that is at least 70% identical to an aa sequence selected from the group consisting of SEQ ID NOs:27-98, or which differs therefrom in at most 30 aa additions, deletions or substitutions.
29. The TFcBA of embodiment 28, wherein the first CH3 domain or the second CH3 domain comprises an aa sequence selected from the group consisting of SEQ ID NOs:27-98.
30. The TFcBA of any one of embodiments 1-28, wherein the first CH3 and second CH3 domains together comprise a pair of two different members, each member being a CH3 aa sequence, each pair selected from the group of pairs consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, each member aa sequence being at least 70% identical to, or differing in at most 30 aa additions, deletions or substitutions from the each sequence of each said pair, wherein the first CH3 domain comprises a different member of the pair than is comprised by the second CH3 domain.
31. The TFcBA of embodiment 30, wherein the first and the second CH3 domains each comprise an aa sequence that identical to an aa sequence of a member of the pair of CH3 aa sequences selected from the group consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98.
32. The TFcBA of any one of embodiments 1-31, wherein the first hinge comprises an aa sequence that differs in at most 3 aa deletions, additions or substitutions from an aa sequence selected from the group consisting of SEQ ID NOs:4, 18, 19, 20, 21, 22, 263-265 and 267-273.
33. The TFcBA of embodiment 32, wherein the first hinge comprises an aa sequence that is an aa sequence selected from the group consisting of SEQ ID NOs:4, 18, 19, 20, 21, 22, 263-265 and 267-273.
34. The TFcBA of any one of embodiments 1-33, wherein the second hinge comprises an aa sequence that differs in at most 3 aa deletions, additions or substitutions from an aa sequence selected from the group consisting of SEQ ID NOs:23, 24, 263-265 and 267-273.
35. The TFcBA of embodiment 34, wherein the second hinge comprises an aa sequence that is an aa sequence selected from the group consisting of SEQ ID NOs:23, 24, 263-265 and 267-273.
36. The TFcBA of any one of embodiments 1-35, comprising a CH2 domain comprising an aa sequence that is at least 70% identical to SEQ ID NO:25, 26, 261 or 262, or which differs therefrom in at most 30 aa deletions, additions or substitutions.
37. The TFcBA of any one of embodiments 1-36, wherein the TFc comprises in amino to carboxyl terminal order: a first hinge, a first CH2 domain, a first CH3 domain, a second hinge, a second CH2 domain and a second CH3 domain, wherein
   a. the first hinge comprises an aa sequence selected from the group consisting of SEQ ID NOs:4, 18, 19, 263-265 and 267-273;
   b. the first CH2 domain is aglycosylated and comprises the aa sequence set forth as SEQ ID NO:25;
   c. the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98;

d. the second hinge comprises an aa sequence consisting of a sequence selected from the group consisting of SEQ ID NO:23, 263-265 and 267-273;

e. the second CH2 domain is aglycosylated and comprises the aa sequence set forth in SEQ ID NO:25; and f. the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

38. The TFcBA of any one of embodiments 1-36, wherein the TFc comprises in amino to carboxyl terminal order: a first hinge, a first CH2 domain, a first CH3 domain, a second hinge, a second CH2 domain and a second CH3 domain, wherein a. the first hinge comprises an aa sequence selected from the group consisting of SEQ ID NOs:20, 21, 22, 263-265 and 267-273;

b. the first CH2 domain is aglycosylated and comprises the aa sequence set forth in SEQ ID NO:26;

c. the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98;

d. the second hinge comprises an aa sequence consisting of SEQ ID NO:24, 263-265 and 267-273;

e. the second CH2 domain is aglycosylated and comprises the aa sequence set forth in SEQ ID NO:26; and f. the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

39. The TFcBA of any one of embodiments 1-38, wherein the first or the second Fc region comprises an aa sequence that is at least 70% identical to an aa sequence selected from the group consisting of SEQ ID NOs:99-166, or differs therefrom in at most 50 aa deletions, additions or substitutions.

40. The TFcBA of any one of embodiment 39, wherein the first or the second Fc region comprises an aa sequence selected from the group consisting of SEQ ID NOs:99-166.

41. The TFcBA of embodiment 39, wherein either or both of the first and the second Fc region comprises an aa sequence that is at least 70% identical to one aa sequence of a pair of aa sequences selected from the group consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:163 and 164; and SEQ ID NOs:165 and 166, or which differs therefrom in at most 50 aa deletions, additions or substitutions, and wherein the first Fc region comprises a different member of the pair than is comprised by the second Fc region.

42. The TFcBA of embodiment 40, wherein the first Fc region and the second Fc region together comprise a pair of two different members, each member being an Fc aa sequence, wherein each pair is selected from the group of pairs consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:163 and 164; and SEQ ID NOs:165 and 166, each member aa sequence being at least 70% identical to, or differing in at most 30 aa additions, deletions or substitutions from each sequence of each said pair, wherein the first Fc region comprises a different member of the pair than is comprised by the second Fc region.

43. The TFcBA of any one of embodiments 1-42, comprising a TFc comprising an aa sequence that is at least 70% identical to an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221 or which differs therefrom in at most 30 aa additions, deletions or substitutions.

44. The TFcBA of embodiment 43, comprising a TFc comprising an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221.

45. The TFcBA of any one of embodiments 1-44, comprising a heavy chain that comprises in amino to carboxyl terminal order: a first heavy chain variable (VH) domain, a TFc, a connecting linker and a second VH domain.

46. The TFcBA of embodiment 45, wherein the heavy chain comprises in amino to carboxyl terminal order: a first VH domain, a CH1 domain, a TFc, a connecting linker and a second VH domain.

47. The TFcBA of embodiment 46, wherein the heavy chain comprises in amino to carboxyl terminal order: a first VH domain, a CH1 domain, a TFc, a connecting linker, a second VH domain, an scFv linker and a second light chain variable (VL) domain, wherein the second VH and VL domains associate to form a second binding site.

48. The TFcBA of embodiment 47, comprising a light chain that comprises a first VL domain that dimerizes with the first VH domain to form a first binding site.

49. The TFcBA of embodiment 48, wherein the light chain comprises a light chain constant (CL) domain that is linked to the carboxyl terminus of the VL domain.

50. The TFcBA of any one of embodiments 1-49, wherein the first binding site is an N-terminal binding site and the second binding site is a C-terminal binding site.

51. The TFcBA of any one of embodiments 1-50, wherein the anti-c-Met binding site comprises a VH comprising either or both of a) the aa sequence of the VH Complementarity Determining Region $(CDR)_3$ (VHCDR3) in SEQ ID NO:223 or 287 and b) a VLCDR3 comprising the aa sequence of the VLCDR3 in SEQ ID NO:231 or 289.

52. The TFcBA of any one of embodiments 1-51, wherein the anti-c-Met binding site comprises a VH domain comprising a set of three VH Complementarity Determining Regions (CDRs) comprising VHCDR1, VCDR2 and VHCDR3, wherein VHCDR1, VHCDR2 and VHCDR3 comprise the aa sequence of the VHCDR1, VHCDR2 and VHCDR3 in SEQ ID NO:223 or 231; and a VL domain comprising a set of three VLCDRs comprising VLCDR1, VLCDR2, and VLCDR3, wherein VLCDR1, VLCDR2 and VLCDR3 comprise the aa sequence of the VLCDR1, VLCDR2 and VLCDR3 in SEQ ID NO:287 or 289, respectively.

53. The TFcBA of any one of embodiments 1-52, wherein the second binding site is an anti-EGFR binding site that comprises either or both of a) a VHCDR3 comprising the aa sequence of the VHCDR3 in SEQ ID NO:233, 237, 258, 275, 277 or 279 and b) a VLCDR3 comprising the aa sequence of the VLCDR3 in SEQ ID NO:233, 237, 258, 275, 277 or 279.

54. The TFcBA of any one of embodiments 1-53, wherein the second binding site is an anti-EGFR binding site that comprises a VH domain comprising a set of three VHCDRs comprising VHCDR1, VCDR2 and VHCDR3, wherein VHCDR1, VHCDR2 and VHCDR3 comprise the aa sequence of the VHCDR1, VHCDR2 and VHCDR3 in SEQ ID NO: 233, 237, 258, 275, 277 or 279; and a VL domain comprising a set of three VLCDRs comprising VLCDR1, VLCDR2, and VLCDR3, wherein VLCDR1, VLCDR2 and VLCDR3 comprise the aa sequence of the VLCDR1, VLCDR2 and VLCDR3 in SEQ ID NO:233, 237, 258, 275, 277 or 279.

55. The TFcBA of any one of embodiments 1-54, wherein the anti-c-Met binding site comprises an N-terminal portion of the heavy chain and an N-terminal portion of the light chain.

56. The TFcBA of any one of embodiments 1-55, wherein the second binding site is comprised by a C-terminal scFv that is entirely comprised by the heavy chain.

57. The TFcBA of any one of embodiments 1-56, wherein the anti-c-Met binding site is comprised by either or both of a VH domain and a VL domain, wherein the VH domain comprises an aa sequence that is at least 70% identical to the VH domain set forth in SEQ ID NOs:223, 231, 287 or 289 or differs therefrom in at most 10 aas deletions, additions or substitution; and the VL domain comprises an aa sequence that is at least 70% identical to the VL domain set forth in SEQ ID NOs:223, 231, 287 or 289 or differs therefrom in at most 10 aas deletions, additions or substitution.

58. The TFcBA of any one of embodiments 1-57, wherein the second binding site is an anti-EGFR binding site that is comprised by either or both of a VH domain and a VL domain, wherein the VH domain comprises an aa sequence that is at least 70% identical to the VH domain set forth in SEQ ID NOs: 233, 237, 258, 275, 277 or 279 or differs therefrom in at most 10 aas deletions, additions or substitution; and the VL domain comprises an aa sequence that is at least 70% identical to the VL domain set forth in SEQ ID NOs: 233, 237, 258, 275, 277 or 279 or differs therefrom in at most 10 aas deletions, additions or substitutions.

59. An Ab which is a TFcBA, wherein the TFcBA comprises a first binding site and a second binding site, wherein the first binding site binds to a first target and the second binding site binds to a second target, and wherein the first and the second binding sites are linked through a TFc;

the TFc comprises a first Fc region and a second Fc region, each said first Fc region and second Fc region having a C-terminus and an N-terminus; the first Fc region and the second Fc region are linked through a TFc linker having a C-terminus and an N-terminus to form a contiguous polypeptide;

the first and the second Fc regions associate to form an Fc dimer; and either or both of the first and the second Fc region comprise one or more aa modification to enhance or stabilize the binding between the first and the second Fc region.

60. The TFcBA of embodiment 59, wherein a. the TFcBA inhibits signal transduction through either or both of the first and the second target; or b. expression of the TFcBA in a cell produces (i) more correctly formed TFcAB molecules relative to the expression of a multivalent antibody that does not comprise a TFc or (ii) more than 80% of correctly formed TFcAB molecules as determined by Size Exclusion Chromatography (SEC).

61. The TFcBA of embodiment 59 or 60, wherein the first Fc region and the second Fc region comprise a first and a second CH3 domain, respectively, each said CH3 domain having a C-terminus and an N-terminus.
62. The TFcBA of anyone of embodiments 59-61, wherein the first and the second Fc regions comprise a first and a second CH2 domain, respectively, each said CH2 domain having a C-terminus and an N-terminus.
63. The TFcBA of anyone of embodiments 59-62, wherein the first and the second Fc regions comprise a first and a second hinge, respectively, each said first hinge and said second hinge having a C-terminus and an N-terminus.
64. The TFcBA of anyone of embodiments 59-63, wherein the second hinge does not comprise an upper hinge subdomain.
65. The TFcBA of embodiment 64, wherein the TFc comprised in the TFcBA comprises in amino to carboxyl terminal order: a first CH2 domain, a first CH3 domain, a TFc linker, a second CH2 domain and a second CH3 domain.
66. The TFcBA of embodiment 64, wherein the TFc comprised in the TFcBA comprises in amino to carboxyl terminal order: a first hinge, a first CH2 domain, a first CH3 domain, a TFc linker, a second CH2 domain and a second CH3 domain.
67. The TFcBA of embodiment 64, wherein the TFc comprised in the TFcBA comprises in amino to carboxyl terminal order: a first hinge, a first CH2 domain, a first CH3 domain, a TFc linker, a second hinge, a second CH2 domain and a second CH3 domain.
68. The TFcBA of embodiment 67, wherein the first hinge comprises an upper hinge subdomain, a core hinge subdomain and a lower hinge subdomain and the second hinge comprises a core hinge subdomain and a lower hinge subdomain, but not an upper hinge subdomain, each said hinge sub-domain having a C-terminus and an N-terminus.
69. A TFcBA of any one of embodiments 59-68, wherein the TFc comprised by the TFcBA comprises in amino to carboxyl terminal order: a first hinge, which is linked at its C-terminus to the N-terminus of a first CH2 domain, which is linked at its C-terminus to the N-terminus of a first CH3 domain, which is linked at its C-terminus to the N-terminus of a TFc linker, which is linked at its C-terminus to the N-terminus of a second hinge, which is linked at its C-terminus to the N-terminus of a second CH2 domain, which is linked at its C-terminus to the N-terminus of a second CH3 domain.
70. The TFcBA of any one of embodiments 59-69, wherein the TFc linker comprises 20-50 aas.
71. The TFcBA of embodiment 70, wherein the TFc linker is a Gly-Ser linker
72. The TFcBA of embodiment 71, wherein the TFc linker comprises $(Gly_4Ser)_n$ (SEQ ID NO: 503), wherein n is 4, 5, 6, 7 or 8 (SEQ ID NO: 490).
73. The TFcBA of any one of embodiments 59-72, wherein the TFc is an IgG1 TFc.
74. The TFcBA of any of embodiments 59-72, wherein the TFc is a hybrid TFc.
75. The TFcBA of embodiment 74, wherein the TFc is an IgG1/IgG4 TFc.
76. The TFcBA of embodiment 73, wherein the TFc comprises in amino to carboxyl terminal order: a first IgG1 hinge, a first IgG1 CH2 domain, a first IgG1 CH3 domain, a TFc linker, a second IgG1 hinge, a second IgG1 CH2 domain, and a second IgG1 CH3 domain.
77. The TFcBA of embodiment 75, wherein the hybrid TFc comprises in amino to carboxyl terminal order: a first IgG1/IgG4 hinge, a first IgG4 CH2 domain, a first IgG1 CH3 domain, a TFc linker, a second IgG4 hinge, a second IgG4 CH2 domain, and a second IgG1 CH3 domain.
78. The TFcBA of anyone of embodiments 59-77, wherein either or both of the first CH3 domain and the second CH3 domain comprise one or more aa modifications that enhance or stabilize the binding between the first and the second Fc regions.
79. The TFcBA of embodiment 78, wherein each of the first CH3 domain and the second CH3 domain comprises an amino acid modification, which modification is an Association Enhancing Modification ("AEM") that enhances the association of the first CH3 domain with the second CH3 domain.
80. The TFcBA of embodiment 79, wherein the AEM is comprised by a module selected from the group consisting of AEM module 1, AEM module 2, AEM module 3 and AEM module 4.
81. The TFcBA of anyone of embodiments 1-80, wherein either or both of the first Fc region and the second Fc region comprises an aa modification that adds a cysteine as an insertion or replacement, which cysteine forms a disulfide bond with a cysteine in the other Fc region (a "DiS" modification).
82. The TFcBA of embodiment 81, wherein either or both of the first Fc region and the second Fc region comprise a DiS modification in a hinge.
83. The TFcBA of embodiment 81, wherein either or both of the first Fc region and the second Fc region comprise a DiS modification in a CH3 domain.
84. The TFcBA of any one of embodiments 80-83, wherein the DiS modification is comprised by DiS module 1 or DiS module 2.
85. The TFcBA of any one of embodiments 59-84, wherein each of the first CH3 domain and the second CH3 domain comprises one or more AEM modifications and one or more DiS modifications.
86. The TFcBA of any one of embodiments 1-85, wherein either or both of the first and the second CH3 domains comprises an aa sequence that is at least 70% identical to an aa sequence selected from the group consisting of SEQ ID NOs:27-98, or which differs therefrom in at most 30 aa additions, deletions or substitutions.
87. The TFcBA of embodiment 28, wherein the first CH3 domain or the second CH3 domain comprises an aa sequence selected from the group consisting of SEQ ID NOs:27-98.
88. The TFcBA of any one of embodiments 1-86, wherein the first CH3 and second CH3 domains together comprise a pair of two different members, each member being a CH3 aa sequence, each pair selected from the group of pairs consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, each member aa sequence being at least 70% identical to, or differing in at most 30 aa additions, deletions or substitutions from the each sequence of each said pair, wherein the first CH3 domain comprises a different member of the pair than is comprised by the second CH3 domain.

89. The TFcBA of embodiment 88, wherein the first and the second CH3 domains each comprise an aa sequence that identical to an aa sequence of a member of the pair of CH3 aa sequences selected from the group consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98.

90. The TFcBA of any one of embodiments 59-89, wherein the first hinge comprises an aa sequence that differs in at most 3 aa deletions, additions or substitutions from an aa sequence selected from the group consisting of SEQ ID NOs:4, 18, 19, 20, 21, 22, 263-265 and 267-273.

91. The TFcBA of embodiment 90, wherein the first hinge comprises an aa sequence that is an aa sequence selected from the group consisting of SEQ ID NOs:4, 18, 19, 20, 21, 22, 263-265 and 267-273

92. The TFcBA of any one of embodiments 59-91, wherein the second hinge comprises an aa sequence that differs in at most 3 aa deletions, additions or substitutions from an aa sequence selected from the group consisting of SEQ ID NOs:23, 24, 263-265 and 267-273.

93. The TFcBA of embodiment 92, wherein the second hinge comprises an aa sequence that is an aa sequence selected from the group consisting of SEQ ID NOs:23, 24, 263-265 and 267-273.

94. The TFcBA of any one of embodiments 59-93, comprising a CH2 domain comprising an aa sequence that is at least 70% identical to SEQ ID NO:25, 26, 261 or 262, or which differs therefrom in at most 30 aa deletions, additions or substitutions.

95. The TFcBA of any one of embodiments 1-94, wherein the TFc comprises in amino to carboxyl terminal order: a first hinge, a first CH2 domain, a first CH3 domain, a second hinge, a second CH2 domain and a second CH3 domain, wherein
   a. the first hinge comprises an aa sequence selected from the group consisting of SEQ ID NOs:4, 18, 19, 263-265 and 267-273;
   b. the first CH2 domain is aglycosylated and comprises the aa sequence set forth as SEQ ID NO:25;
   c. the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98;
   d. the second hinge comprises an aa sequence consisting of a sequence selected from the group consisting of SEQ ID NO:23, 263-265 and 267-273;
   e. the second CH2 domain is aglycosylated and comprises the aa sequence set forth in SEQ ID NO:25; and
   f. the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

96. The TFcBA of any one of embodiments 59-94, wherein the TFc comprises in amino to carboxyl terminal order: a first hinge, a first CH2 domain, a first CH3 domain, a second hinge, a second CH2 domain and a second CH3 domain, wherein
   a. the first hinge comprises an aa sequence selected from the group consisting of SEQ ID NOs:20, 21, 22, 263-265 and 267-273;
   b. the first CH2 domain is aglycosylated and comprises the aa sequence set forth in SEQ ID NO:26;
   c. the first CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98;
   d. the second hinge comprises an aa sequence consisting of SEQ ID NO:24, 263-265 and 267-273;
   e. the second CH2 domain is aglycosylated and comprises the aa sequence set forth in SEQ ID NO:26; and
   f. the second CH3 domain comprises an aa sequence that is either sequence of a pair of sequences selected from the group of pairs of CH3 domain sequences consisting of SEQ ID NOs:31 and 35; SEQ ID NOs:33 and 37; SEQ ID NOs:39 and 43; SEQ ID NOs:41 and 45; SEQ ID NOs:47 and 51; SEQ ID NOs:49 and 53; SEQ ID NOs:55 and 59; SEQ ID NOs:57 and 61; SEQ ID NOs:63 and 67; SEQ ID NOs:65 and 69; SEQ ID NOs:71 and 73; SEQ ID NOs:72 and 74; SEQ ID NOs:75 and 79; SEQ ID NOs:77 and 81; SEQ ID NOs:83 and 85; SEQ ID NOs:84 and 86; SEQ ID NOs:87 and 89; SEQ ID NOs:88 and 90; SEQ ID NOs:91 and 93; SEQ ID NOs:92 and 94; SEQ ID NOs:95 and 97; and SEQ ID NOs:96 and 98, wherein if the first CH3 domain comprises a first sequence of a pair of sequences, the second CH3 domain comprises the second sequence of the pair of sequences; and if the first CH3 domain comprises the second sequence of a pair of sequences, the second CH3 domain comprises the first sequence of the pair of sequences.

97. The TFcBA of any one of embodiments 59-96, wherein the first or the second Fc region comprises an aa sequence that is at least 70% identical to an aa sequence selected from the group consisting of SEQ ID NOs:99-166, or differs therefrom in at most 50 aa deletions, additions or substitutions.

98. The TFcBA of any one of embodiment 97, wherein the first or the second Fc region comprises an aa sequence selected from the group consisting of SEQ ID NOs:99-166.

99. The TFcBA of embodiment 97, wherein either or both of the first and the second Fc region comprises an aa sequence that is at least 70% identical to one aa sequence of a pair of aa sequences selected from the group consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:3 and 164; and SEQ ID NOs:165 and 166, or which differs therefrom in at most 50 aa deletions, additions or substitutions, and wherein the first Fc region comprises a different member of the pair than is comprised by the second Fc region.

100. The TFcBA of embodiment 99, wherein the first Fc region and the second Fc region together comprise a pair of two different members, each member being an Fc aa sequence, wherein each pair is selected from the group of pairs consisting of SEQ ID NOs:99 and 100; SEQ ID NOs:101 and 102; SEQ ID NOs:103 and 104; SEQ ID NOs:105 and 106; SEQ ID NOs:107 and 108; SEQ ID NOs:109 and 110; SEQ ID NOs:111 and 112; SEQ ID NOs:113 and 114; SEQ ID NOs:115 and 116; SEQ ID NOs:117 and 118; SEQ ID NOs:119 and 120; SEQ ID NOs:121 and 122; SEQ ID NOs:123 and 124; SEQ ID NOs:125 and 126; SEQ ID NOs:127 and 128; SEQ ID NOs:129 and 130; SEQ ID NOs:131 and 132; SEQ ID NOs:133 and 134; SEQ ID NOs:135 and 136; SEQ ID NOs:137 and 138; SEQ ID NOs:139 and 140; SEQ ID NOs:141 and 142; SEQ ID NOs:143 and 144; SEQ ID NOs:145 and 146; SEQ ID NOs:147 and 148; SEQ ID NOs:149 and 150; SEQ ID NOs:151 and 152; SEQ ID NOs:153 and 154; SEQ ID NOs:155 and 156; SEQ ID NOs:157 and 158; SEQ ID NOs:159 and 160; SEQ ID NOs:161 and 162; SEQ ID NOs:163 and 164; and SEQ ID NOs:165 and 166, each member aa sequence being at least 70% identical to, or differing in at most 30 aa additions, deletions or substitutions from each sequence of each said pair, wherein the first Fc region comprises a different member of the pair than is comprised by the second Fc region.

101. The TFcBA of any one of embodiments 59-100, comprising a TFc comprising an aa sequence that is at least 70% identical to an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221 or which differs therefrom in at most 30 aa additions, deletions or substitutions.

102. The TFcBA of embodiment 101, comprising a TFc comprising an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221.

103. The TFcBA of any one of embodiments 59-102, comprising a heavy chain that comprises in amino to carboxyl terminal order: a first heavy chain variable (VH) domain, a TFc, a connecting linker and a second VH domain.

104. The TFcBA of embodiment 103, wherein the heavy chain comprises in amino to carboxyl terminal order: a first VH domain, a CH1 domain, a TFc, a connecting linker and a second VH domain.

105. The TFcBA of embodiment 104, wherein the heavy chain comprises in amino to carboxyl terminal order: a first VH domain, a CH1 domain, a TFc, a connecting linker, a second VH domain, an scFv linker and a second light chain variable (VL) domain, wherein the second VH and VL domains associate to form a second binding site.

106. The TFcBA of embodiment 105, comprising a light chain that comprises a first VL domain that dimerizes with the first VH domain to form a first binding site.

107. The TFcBA of embodiment 106, wherein the light chain comprises a light chain constant (CL) domain that is linked to the carboxyl terminus of the VL domain.

108. The TFcBA of any one of embodiments 59-107, wherein the first binding site is an anti-c-Met binding site and the second binding site is an anti-EGFR binding site.

109. A monovalent TFcA, comprising a binding site that is linked to a TFc comprising a first Fc region and a second Fc region linked through a TFc linker, wherein the first and the second Fc region associate to form an Fc, and wherein either or both of the first and the second Fc region comprise one or more aa modification to enhance or stabilize the binding between the first and the second Fc region.

110. A TFcA or TFcBA of any one of embodiments 1-109 that is a charge-complementary paired TFcA or TFcBA, wherein a charge-complementary paired TFcA or TFcBA is a TFcA or TFcBA that comprises a pair of charged amino acids comprising an amino acid selected from group A and an amino acid selected from group B (a charge-complementary pair)

wherein group A comprises all natural amino acids with a pI of greater than 7 and group B comprises all natural amino acids with a pI of less than 7, or optionally wherein group A comprises His, Lys, and Arg, and group B comprises Asp, Glu, Asn, Phe, Gln, Tyr, Ser, Met, Thr, Ile, Gly, Val, Trp, Leu, Ala, and Pro; and said charge-complementary pair consists of a first amino acid residue and a second amino acid residue, and said charge-complementary pair is a position 297 charge-complementary pair or a position 299 charge-complementary pair, wherein a position 297 charge-complementary pair is a charge-complementary pair with said first amino acid residue located at EU position 297 of said first Fc region and said second amino acid residue located at EU position 297 of said second Fc region, and a position 299 charge-complementary pair is a charge-complementary pair with said first amino acid residue located at EU position 299 of said first Fc region and said second amino acid residue located at EU position 299 of said second Fc region.

111. The charge-complementary paired TFcA or TFcBA of embodiment 110, wherein the charge-complementary paired TFcA or TFcBA comprises both a position 297 charge-complementary pair and a position 299 charge-complementary pair, wherein the first and second amino acid residues of the position 297 charge-complementary pair are the same as or different from the first and second amino acid residues of the position 299 charge-complementary pair.

112. The charge-complementary paired TFcA or TFcBA of embodiment 110 or 111, wherein the charge-complementary paired TFcA or TFcBA comprises a position 297 charge-complementary pair and wherein the charge-complementary paired TFcA or TFcBA is more stable than a TFcA or TFcBA that is not a charge-complementary paired TFcA or TFcBA but that is identical to the charge-complementary paired TFcA or TFcBA except that amino acid residues corresponding to the first and the second amino acid residues are both residues consisting of the same charged amino acid, said same charged amino acid being one of the amino acids of the position 297 charge-complementary pair of the charge-complementary paired TFcA or TFcBA.

113. The charge-complementary paired TFcA or TFcBA of embodiment 110, 111 or 112, wherein the charge-complementary paired TFcA or TFcBA comprises a position 299 charge-complementary pair and wherein the charge-complementary paired TFcA or TFcBA is more stable than a TFcA or TFcBA that is not a charge-complementary paired TFcA or TFcBA but that is identical to the charge-complementary paired TFcA or TFcBA except that amino acid residues corresponding to the first and the second amino acid residues are both residues consisting of the same charged amino acid, said same charged amino acid being one of the amino acids of the position 299 charge-complementary pair of the charge-complementary paired TFcA or TFcBA.

114. The TFcA or TFcBA of any one of embodiments 59-113, wherein the first or the second binding site binds specifically to a human protein selected from the group consisting of ErbB2, ErbB3, ErbB4, IGF1R, IGF2R, Insulin receptor, Ron, c-Met, EGFR, VEGFR1, VEGFR2, TNFR, FGFR1FGFR2, FGFR3, FGFR4, PDGFR alpha, PDGFR beta, c-Kit, EPCAM and EphA2.

115. A pharmaceutical composition comprising a TFcA or TFcBA of any one of embodiments 1-114 and a pharmaceutically acceptable carrier.

116. A nucleic acid molecule comprising at least one coding sequence, said at least one coding sequence encoding a heavy chain or a light chain of a TFcA or TFcBA of any one of embodiments 1-114.

117. A nucleic acid molecule comprising at least two coding sequences, wherein one coding sequence encodes a heavy chain of a TFcA or TFcBA of any one of embodiments 1-114 and a second coding sequence encodes a light chain of the TFcBA.

118. A vector comprising one or more nucleic acid molecules of embodiments 116 or 117.

119. A cell comprising one or more vectors of embodiment 118 or nucleic acid molecule of embodiments 116 or 117.

120. A cell comprising a nucleic acid molecule encoding the heavy chain of a TFcA or TFcBA of any one of embodiments 1-114 and a nucleic acid molecule encoding the light chain of the TFcA or TFcBA.

121. A method of producing a TFcA or TFcBA comprising culturing the host cell of embodiment 119 or 120 under conditions in which the nucleic acids are expressed, and isolating the TFcA or TFcBA.

122. A method for producing a TFcA or TFcBA, comprising culturing a cell of embodiment 119 or 120 under conditions suitable for the expression of the TFcA or TFcBA.

123. A method of treating a subject having cancer, said method comprising administering to a subject a therapeutically effective amount of a TFcA or TFcBA, nucleic acid molecule, or vector of any one of embodiments 1-120.

Further exemplary embodiments include but are not limited to the following items in connection with the subject matter which may be embodied.

A1'. A Tandem Fc Bispecific Antibody ("TFcBA") that comprises two polypeptide chains, a large chain and a Fab light chain, each chain having a C-terminus and an N-terminus, the TFcBA comprising a first binding site comprised by a Fab moiety comprising the Fab light chain and a Fab heavy chain, which Fab heavy chain is at the N-terminus of the large chain, which Fab moiety specifically binds to cMET, and which TFcBA further comprises a second binding site comprised by a single chain Fv (scFV) moiety at the C-terminus of the large chain, which scFv moiety specifically binds to EpCAM, wherein:

(a) the Fab heavy chain and the scFv moiety are linked through a Tandem Fc ("TFc");
(b) the TFc is comprised by the large chain and has a first Fc region and a second Fc region which are linked through a TFc linker to form a contiguous polypeptide; and
(c) the first and the second Fc regions associate to form an Fc dimer, and further wherein
(d) the Fab light chain comprises an amino acid sequence comprising the three light chain CDRs present SEQ ID NO:400; and
(e) the Fab heavy chain comprises an amino acid sequence comprising the three heavy chain CDRs present in SEQ ID NO:423.

A2'. The TFcBA of embodiment A1', wherein the scFV moiety comprises an amino acid sequence that is SEQ ID NO:488.

A3'. The TFcBA of embodiment A1' or of embodiment A2' wherein the TFcBA large chain comprises, in N-terminal to C-terminal order:

(i) the Fab heavy chain variable region IgG1 CH1 domain;
(ii) a hybrid hinge containing an IgG1 upper hinge and an IgG4 middle and lower hinge;
(iii) a first IgG4 CH2 domain comprising a T299K mutation;
(iv) an first IgG1 CH3 domain comprising T366S, L368A, and Y407V mutations;
(v) a first disulfide bridge motif (KSCDKT) (SEQ ID NO: 167);
(vi) a Tandem Fc linker, optionally a linker comprising the aa sequence $(G_4S)_8$ (SEQ ID NO: 491);
(vii) an IgG4 middle and lower hinge;
(viii) a second IgG4 CH2 domain comprising a T299D mutation;
(ix) a second IgG1 CH3 domain comprising a T366W mutation;
(x) a second disulfide bridge motif (GEC) (SEQ ID NO: 168);
(xi) a connecting linker; and
(xii) the scFv.

A4'. The TFcBA of any of embodiments A1'-A3' wherein the TFcBA exhibits a Kd for binding to cMET of less than about 10e-8, 10e-9, 10e-10, 10e-11, 10e-12, or 10e-13 M.

A5'. The TFcBA of embodiment A4' wherein the TFcBA exhibits a Kd for binding to cMET of from 3.0×10e-8 to 2.5×10e-9 M.

A6'. The TFcBA of any of embodiments A1'-A3' wherein the TFcBA exhibits a Kd for binding to EpCAM of less than about 10e-7 or 10e-8, or optionally 10e-9 M.

A7'. The TFcBA of embodiment A6' wherein the TFcBA exhibits a Kd for binding to cMET of from 10e-8 to 10e-11 M.

A8'. The TFcBA of any of embodiments A1'-A3' wherein a TFc linker sequence comprises an amino acid sequence of SEQ ID NO:169.

A9'. The TFcBA of any of embodiments A1'-A3' wherein the TFc comprises an amino acid sequence selected from the group consisting of SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193 and SEQ ID NO:195.

A10'. A TFcBA molecule comprising a large chain comprising an amino acid sequence that is SEQ ID NO 489.

A11'. A method of treating a cancer patient, the method comprising administering to the patient a therapeutically effective amount of the TFcBA of any one of the preceding embodiments to the patient and optionally wherein the therapeutically effective amount is from 100 ng/kg of patient body weight to 15 mg/kg of patient body weight, and further optionally wherein the therapeutically effective amount is from 1 mg/kg patient body weight to 25 mg/kg patient body weight.

A12'. The method of embodiment A11', wherein the cancer is a type of cancer disclosed herein and optionally wherein the therapeutically effective amount is from 1 mg/kg of patient body weight to 10 mg/kg of patient body weight.

A13'. A method of inhibiting tumor growth in a cancer patient, the method comprising administering to the patient a therapeutically effective amount of a TFcBA of any one of the embodiments A1' to A10' to the patient, optionally wherein the therapeutically effective amount is from 100 ng/kg of patient body weight to 15 mg/kg of patient body weight, from 1 mg/kg of patient body weight to 10 mg/kg of patient body weight, or from 1 mg/kg of patient body weight to 25 mg/kg of patient body weight.

A14'. A method of inhibiting tumor cell proliferation, the method comprising contacting a tumor cell with a fluid comprising a concentration of a TFcBA of any one of the embodiments A1' to A10', which concentration of the TFcBA is effective to inhibit proliferation of the tumor cells.

A15'. A pharmaceutical formulation comprising the TFcBA of any one of embodiments A1' to A10' and a pharmaceutical carrier.

A16'. The pharmaceutical formulation of embodiment A15', wherein the formulation is a sterile formulation suitable for injection, intraveneous injection and/or infusion.

A17'. The pharmaceutical formulation of embodiment A15' or embodiment A16', wherein the formulation is packaged in a pharmaceutically acceptable container.

A18'. A nucleic acid molecule encoding a protein amino acid sequence of any of embodiments A1' to A10'.

A19'. A vector comprising the nucleic acid molecule of embodiment A18'.

A20'. A host cell comprising a vector comprising the nucleic acid molecule of embodiment A18'.

A21'. The host cell of embodiment A20' wherein the host cell expresses the encoded protein.

A22'. The TFcBA of any of embodiments A1-10' wherein, when the TFcBA is contacted with cells expressing both cell surface c-Met and cell surface EPCAM, the amount of total c-Met measured in the cells subsequent to contact is lower than the amount of total c-Met measured in matched cells prior to contact.

A23'. The TFcBA of embodiment A22', wherein, when the TFcBA is contacted with cells expressing both cell surface c-Met and cell surface EPCAM, the amount of total EPCAM measured in the cells is essentially unchanged.

BRIEF DESCRIPTION OF THE DRAWINGS

FIG. 1A and FIG. 1B: Diagram of an exemplary anti-c-Met/anti-EGFR Tandem Fc Bispecific Antibody ("TFcBA") (FIG. 1A) and exemplary mutations in each of the domains of the Tandem Fc ("TFc") (FIG. 1B).

FIG. 1A: Diagram of an exemplary anti-c-Met/anti-EGFR TFcBA comprising the following three modules in amino to carboxyl terminal order: 1) a first module consisting of an anti-c-Met binding site; 2) a second module consisting of a TFc; and 3) a third module consisting of an anti-EGFR binding site. In the exemplified TFcBA, the first module is an anti-c-Met Fab and the third module is an anti-EGFR scFv. The TFc comprises two Fc regions that are linked through a TFc linker. In the exemplified TFcBA, the first Fc region comprises a full length IgG1/IgG4 hybrid hinge, an IgG4 CH2 domain, and an IgG1 CH3 domain, and the second Fc region comprises the core and lower hinge of IgG4 (but does not comprise an upper hinge), an IgG4 CH2 domain and an IgG1 CH3 domain. In the exemplified TFcBA, the CH3 domain comprises one or more Association Enhancing Modifications ("AEMs"), which enhance the association between two CH3 domains or two Fc regions. TFcBAs may also comprise one or more disulfide bond forming modifications ("DiSs"), which introduce cysteines allowing for the formation of disulfide bonds between two Fc regions.

FIG. 1B: Diagram of the structure of a TFc showing in amino to carboxyl terminal order: the first hinge, the first CH2 domain, the first CH3 domain, the TFc linker, the second hinge, the second CH2 domain and the second CH3 domain. Exemplary sequences and domain modifications for each of these domains are shown below the diagram. The name of the first or second CH3 modification in each AEM or DiS is indicated in parenthesis after the name of the modification, wherein the first numeral after "AEM" or "DiS" refers to the module number of the AEM or DiS, respectively, and the second numeral refers to the first or the second of the two CH3 domains. For example, "AEM 1.1" is indicated after the substitutions "T366S/L368A/Y407V," which substitutions are the combination of substitutions in one of the two CH3 domains of a pair of modifications in AEM module 1. A TFc may comprise any combination of each of these domains, with the proviso that when one of the CH3 domain of the TFc comprises one of the two modifications of an AEM and/or DiS, the other CH3 domain comprises the second, i.e., compatible, modification(s) of the AEM and/or DiS. For example, if one CH3 domain of a TFc comprises AEM 1.1, the other CH3 domain comprises AEM 1.2. "C-term. Cys" refers to a modification adding a C-terminal Cysteine to the CH3 domain by substituting the last three aas of the CH3 domain with those shown in the Figure. Aa residue numbers in this Figure and the other Figures are those in an intact antibody heavy chain, according to the EU index in Kabat. Figures discloses the "(G4S)$_n$" linkers as SEQ ID NOS 497-499 and 491, respectively, in order of appearance, and "KSCDKT" and "GEC" as SEQ ID NOS 167 and 168, respectively.

FIGS. 2A-2E: Alignment of aa sequences of wild type and variant hinges. A dash "-" at a position represents an aa that is identical to that in the first line of the figure at that position. FIG. 2A) Aa sequences of full length (SEQ ID NOs:4, 18 and 19) or partial (SEQ ID NOs:1, 2, 3, 16, 17, 23 and 263-265) IgG1 hinges that are wild type (SEQ ID NOs:1-4 and 23) or modified (SEQ ID NOs:16-19 and 263-265). FIG. 2B) Aas of full length (SEQ ID NOs:20, 21 and 22) or partial (SEQ ID NOs:1, 13, 14 and 24) IgG1/IgG4 hybrid hinges that are wild type (SEQ ID NOs:1, 13, 14, 20 and 24) or modified (SEQ ID NOs:21 and 22). FIG. 2C) Aa sequences of full length wild type mIgG1 hinge (SEQ ID NO:266) and hybrid mIgG1/mIgG2A hinge (SEQ ID NO:267). FIG. 2D) Aa sequence of a full length, wild type hIgG2 hinge (SEQ ID NO:7) and modified hIgG2 hinges (SEQ ID NOs:268 and 269). FIG. 2E) Aa sequence of a full length wild type hIgA2 hinge (SEQ ID NO:270) and modified hIgA2 hinges (SEQ ID NOs:271-273).

FIG. 3: Alignment of IgG1 CH3 aa sequences with or without various aa modifications. Each line is the aa sequence of a different CH3 domain. A dash "-" at a position represents an aa that is identical to that in the first line of the figure at that position. The CH3 modifications are organized according to their module, e.g., AEM module 1. Each module is divided into two groups labeled with two numerals: for example, AEM module 1 is divided into the groups "AEM 11" and "AEM 12," wherein AEM 11 represents the modifications made to one CH3 domain (domain "1") of module AEM 1 and AEM 12 represents the modifications made to the second CH3 domain (domain "2") of the module. Each line within a module represents a CH3 domain having the modifications of the module with or without other modifications. The CH3 aa sequences within one module differ from each other, e.g., in the presence or absence of the carboxyl terminal lysine and/or in the presence of the substitutions D356E and L358M.

FIG. 4: Alignment of exemplary IgG1 Fc regions. Each line is the aa sequence of a different Fc region. A dash "-" at a position represents an aa that is identical to that in the first line of the figure at that position. Each Fc region comprises a hinge (boldface in first sequence), CH2 and CH3 domain (the CH3 domain is underlined in the first sequence). The SEQ ID NOs of the hinge, CH2 and CH3 sequences of each Fc in this Figure are provided in Table 8. The Fcs are organized in pairs, which are separated form other pairs by lines, and wherein each pair represents compatible Fcs, i.e., Fcs that can associate with each other to form an Fc dimer.

FIG. 5: Alignment of exemplary IgG1/IgG4 hybrid Fc regions. Each line is the aa sequence of a different Fc region. A dash "-" at a position represents an aa that is identical to that in the first line of the figure at that position. Each Fc region comprises a hinge (boldface in the first sequence), CH2 and CH3 domain (the CH3 domain is underlined in the first sequence). The SEQ ID NOs of the hinge, CH2 and CH3 sequences of each Fc in this Figure are provided in Table 9. The Fcs are organized in pairs, which are separated form other pairs by lines, and wherein each pair represents compatible Fcs, i.e., Fcs that can associate with each other to form an Fc dimer.

FIG. 6: Aa sequences of the following IgG1 TFcs: 23 (SEQ ID NO:171); 23A (SEQ ID NO:173); 23B (SEQ ID NO:175); 23C (SEQ ID NO:177); 23D (SEQ ID NO:179); 23E (SEQ ID NO:181); 23F (SEQ ID NO:183); 23E (35L) (SEQ ID NO:185); 23E (35L Inverted) (SEQ ID NO:187); 23E (30L) (SEQ ID NO:189); 23E (25L) (SEQ ID NO:191); 231 (SEQ ID NO:193); and 23J (SEQ ID NO:195). Each of these sequences consists of the following domains in amino to carboxyl terminal order: a first IgG1 hinge (double underlined), an IgG1 CH2 domain, an IgG1 CH3 domain (underlined), a (G4S)$_n$ linker (SEQ ID NO: 492) (in italics), a second IgG1 hinge (doubly underlined, and consisting of the core and lower hinges only), a second IgG1 CH2 domain and a second IgG1 CH3 domain (underlined). The aa changes that are specific to each of these molecules are shown in boldface, and are named above the sequence. Figure discloses "KSCDKT," "GEC," "(G45)4," "(G45)7," "(G45)6" and "(G4S)5" as SEQ ID NOS 167, 168, 496, 499, 498 and 497, respectively.

FIG. 7: Aa sequences of the following IgG1/IgG4 hybrid TFcs: 39 (SEQ ID NO:197); 39A (SEQ ID NO:199); 39B (SEQ ID NO:201); 39C (SEQ ID NO:203); 39D (SEQ ID NO:205); 39E (SEQ ID NO:207); 39F (SEQ ID NO:209); 39E (35L) (SEQ ID NO:211); 39 E (35L Inverted) (SEQ ID NO:213); 39E (30L) (SEQ ID NO:215); 39E (25L) (SEQ ID NO:217); 391 (SEQ ID NO:219); 39J (SEQ ID NO:221). Each of these sequences consist of the following domains in amino to carboxyl terminal order: a first IgG1/IgG4 hybrid hinge consisting of the IgG1 upper hinge and IgG4 core and lower hinges (double underlined), an IgG4 CH2 domain, an IgG1 CH3 domain (underlined), a (G4S)$_n$ linker (SEQ ID NO: 492) (in italics), a second IgG4 hinge (double underlined, and consisting of the core and lower hinges only), a second IgG4 CH2 domain and a second IgG1 CH3 domain (underlined). The IgG1 sequences are in upper case letters and the IgG4 sequences are in lower case letters. The aa changes that are specific to each of these molecules are shown in boldface, and are named above the sequence. Figure discloses "KSCDKT," "GEC," "(G4S)4," "(G4S)7," "(G4S)6" and "(G4S)5" as SEQ ID NOS 167, 168, 496, 499, 498 and 497, respectively.

FIG. 9: Aa sequences of heavy chains of the following exemplary anti-c-Met/anti-EGFR TFcBAs: TFcBAs comprising a humanized 5D5 VH domain and an anti-EGFR scFv comprising the aa sequences of the VH and VL domains of A), B), C), D) E), L) and M) panimumumab (SEQ ID NO:235); F) 2224 (SEQ ID NO:239); G) cetuximab H1L1(SEQ ID NO:260); H) cetuximab H1L2 (SEQ ID NO:281); I) cetuximab H2L1 (SEQ ID NO:283); and J) cetuximab H2L2 (SEQ ID NO:285). K) aa sequence of the heavy chain of anti-c-Met/anti-EGFR TFcBA comprising the VH domain of anti-c-Met binding site 2 and humanized anti-EGFR cetuximab scFv H1L1. The aas that were introduced into the cetuximab VH domains for humanization purposes are indicated in lower case. The CDRs of the anti-c-Met Fab are underlined with a dotted line. The CH1 domain is underlined with a wavy line. The hinges are double underlined. The TFc linker is in italics. The CH3 domains are underlined. The AEM and DiS modifications in the CH3 domains are in boldface. The scFv linker is in italics and underlined. The connecting linker is in italics and double underlined.

FIG. 10: Nucleotide sequences encoding the aa sequences set forth in the Figures and in the specification. Figure discloses "G4S" as SEQ ID NO: 492.

FIG. 11: Nucleotide and aa sequences of TFcs used in Examples 1 and 2. Each of the aa sequences consists of the following domains in amino to carboxyl terminal order: a signal peptide (underlined and boldface), a first IgG1 hinge (double underlined), an IgG1 CH2 domain, an IgG1 CH3 domain (underlined), a TFc linker (in italics), a second IgG1 hinge (doubly underlined, and consisting of the core and lower hinges only), a second IgG1 CH2 domain and a second IgG1 CH3 domain (underlined). IgG1 aas are in upper case and IgG4 aas are in lower case. The aa changes that are specific to each of these molecules, e.g., AEMs and DiSs modifications, are shown in boldface, and are named above the sequence. Figure discloses "KSCDKT," "GEC," "(G4S)4," "(G4S)7," "(G4S)6" and "(G4S)5" as SEQ ID NOS 167, 168, 496, 499, 498 and 497, respectively.

FIG. 14: Nucleotide and aa sequences of exemplary TFcBAs.

FIG. 17: Nucleotide and aa sequences of glycosylation mutants of the exemplary TFcBAs set forth in Table 23. Figure discloses "KSCDKT" and "GEC" as SEQ ID NOS 167 and 168, respectively.

FIG. 19: Table showing structural characteristics of anti-c-Met/anti-EpCam Tandem Fc Bispecific Antibodies Ab#1-Ab#13.

BRIEF DESCRIPTION OF THE SEQUENCES

Figure 1A:
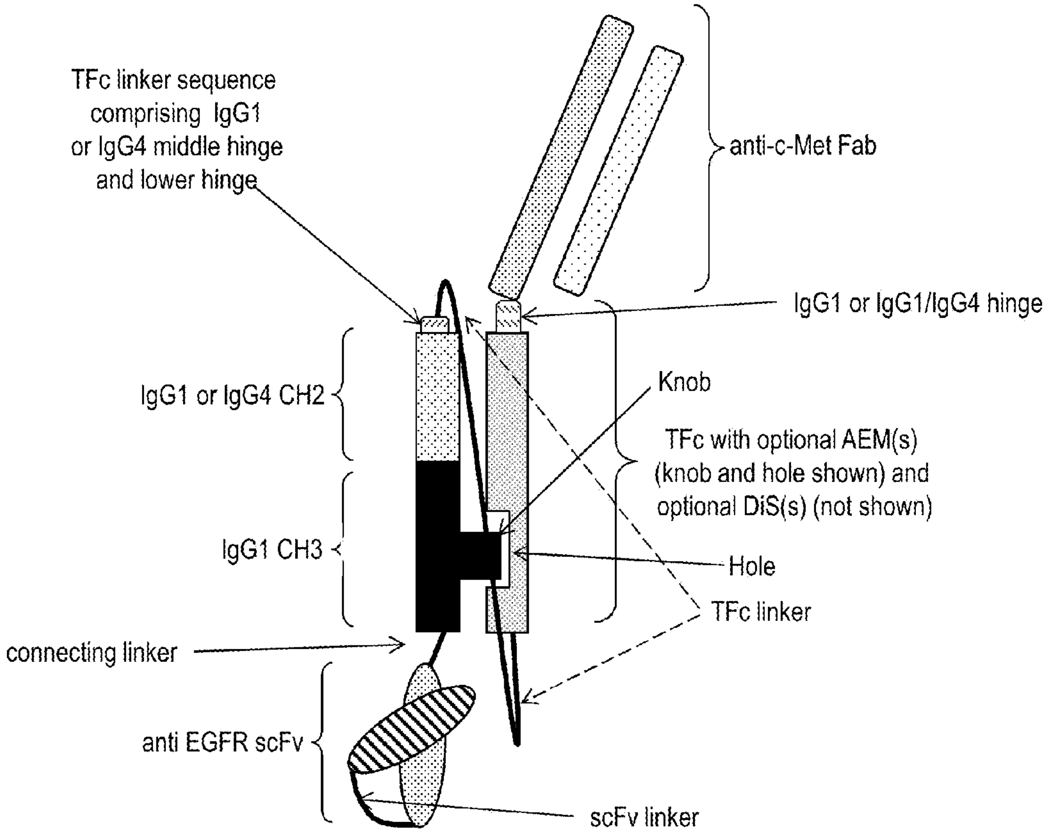

The amino acid ("aa") sequences referred to herein and listed in the sequence listing are identified below.

SEQ ID NOs:1, 2 and 3 are the aa sequences of the wild type IgG1 upper, middle (or core) and lower hinge, respectively (see Table 2).

SEQ ID NO:4 is the aa sequence of the complete wild type IgG1 hinge, consisting of SEQ ID NOs:1, 2 and 3 in a contiguous sequence in amino to carboxyl terminal order (see Table 2).

SEQ ID NOs:5 and 6 are the aa sequences of the wild type IgG2 upper and lower hinge, respectively (see Table 2). The IgG2 middle hinge is the same as that of IgG1, i.e., SEQ ID NO:2.

SEQ ID NO:7 is the aa sequence of the complete wild type IgG2 hinge, consisting of SEQ ID NOs:5, 2 and 6 in a contiguous sequence in amino to carboxyl terminal order (see Table 2).

SEQ ID NOs:8, 9 and 10 are the aa sequences of the wild type IgG3 upper, middle and lower hinge, respectively (see Table 2).

SEQ ID NO:11 is the aa sequence of the complete wild type IgG3 hinge, consisting of SEQ ID NOs:8, 9 and 10 in a contiguous sequence in amino to carboxyl terminal order (see Table 2).

SEQ ID NOs:12, 13 and 14 are the aa sequences of the IgG4 upper, middle and lower hinge, respectively (see Table 2).

SEQ ID NO:15 is the aa sequence of a full length IgG4 hinge, consisting of SEQ ID NOs:12, 13 and 14 in a contiguous sequence in amino to carboxyl terminal order (see Table 2).

SEQ ID NO:16 is the aa sequence of the IgG1 upper hinge (SEQ ID NO:1) comprising the aa substitutions H224C and T225C (see Table 4 and FIG. 2).

SEQ ID NO:17 is the aa sequence of the IgG1 upper hinge (SEQ ID NO:1) comprising the aa substitution T223C (see Table 4 and FIG. 2).

SEQ ID NO:18 is the aa sequence of the full length IgG1 hinge (SEQ ID NO:4) comprising the aa substitutions H224C and T225C (see Table 4 and FIG. 2).

SEQ ID NO:19 is the aa sequence of the full length IgG1 hinge (SEQ ID NO:4) comprising the aa substitution T223C (see Table 4 and FIG. 2).

SEQ ID NO:20 is the aa sequence of a full length hybrid IgG1/IgG4 hinge, consisting of the upper hinge of IgG1 (SEQ ID NO:1) and the middle and lower hinges of IgG4 (SEQ ID NOs:13 and 14, respectively; see Table 4 and FIG. 2).

SEQ ID NO:21 is the aa sequence of a full length hybrid IgG1/IgG4 hinge, consisting of the upper hinge of IgG1 comprising the aa substitutions H224C and T225C (SEQ ID NO:16) and the middle and lower hinges of IgG4 (SEQ ID NOs:13 and 14, respectively; see Table 4 and FIG. 2).

SEQ ID NO:22 is the aa sequence of a full length hybrid IgG1/IgG4 hinge, consisting of the upper hinge of IgG1 comprising the aa substitution T223C (SEQ ID NO:17) and the middle and lower hinges of IgG4 (SEQ ID NOs:13 and 14, respectively; see Table 4 and FIG. 2).

SEQ ID NO:23 is the aa sequence of a partial IgG1 hinge comprising the middle and lower IgG1 hinges (SEQ ID NOs:2 and 3), but not the upper hinge (see Table 4 and FIG. 2).

SEQ ID NO:24 is the aa sequence of a partial IgG4 hinge comprising the middle and lower IgG4 hinges (SEQ ID NOs:13 and 14), but not the upper hinge (see Table 4 and FIG. 2).

SEQ ID NO:25 is the aa sequence of a full length IgG1 CH2 domain with the aa substitution N297Q reducing glycosylation at aa 297.

SEQ ID NO:26 is the aa sequence of a full length wild type IgG4 CH2 domain with the aa substitution T299K reducing glycosylation at aa 297.

SEQ ID NO:27 is the aa sequence of a full length wild type human IgG1 CH3 domain (see Table 6 and FIG. 3).

SEQ ID NO:28 is the aa sequence of the wild type IgG1 CH3 domain having SEQ ID NO:27, but lacking the C-terminal lysine (see Table 6 and FIG. 3).

SEQ ID NO:29 is the aa sequence of the IgG1 CH3 domain having SEQ ID NO:27 with the substitutions D356E and L358M (see Table 6 and FIG. 3).

SEQ ID NO:30 is the aa sequence of the IgG1 CH3 domain having SEQ ID NO:29, lacking the C-terminal lysine (see Table 6 and FIG. 3).

SEQ ID NO:31 is the aa sequence of the IgG1 CH3 domain having SEQ ID NO:27 with the substitutions T366S, L368A and Y470V, creating a "hole" (Association Enhancing Modification or "AEM" 1.1; see Table 6 and FIG. 3).

SEQ ID NO:32 is the aa sequence of the IgG1 CH3 domain having SEQ ID NO:31, lacking the C-terminal lysine (see Table 6 and FIG. 3).

SEQ ID NO:33 is the aa sequence of the IgG1 CH3 domain having SEQ ID NO:29 with the substitutions T366S, L368A and Y470V, creating a "hole" (AEM 1.1; see Table 6 and FIG. 3).

SEQ ID NO:34 is the aa sequence of the IgG1 CH3 domain having SEQ ID NO:33, lacking the C-terminal lysine (see Table 6 and FIG. 3).

SEQ ID NO:35 is the aa sequence of the IgG1 CH3 domain having SEQ ID NO:27 with the substitution T366W, creating a "bump" or "knob" (AEM 1.2; see Table 6 and FIG. 3).

SEQ ID NO:36 is the aa sequence of the IgG1 CH3 domain having SEQ ID NO:35, lacking the C-terminal lysine (see Table 6 and FIG. 3).

SEQ ID NO:37 is the aa sequence of the IgG1 CH3 domain having SEQ ID NO:29 with the substitution T366W, creating a "bump" or "knob" (AEM 1.2; see Table 6 and FIG. 3).

SEQ ID NO:38 is the aa sequence of the IgG1 CH3 domain having SEQ ID NO:37, lacking the C-terminal lysine (see Table 6 and FIG. 3).

SEQ ID NOs:39-98 are the aa sequences of IgG1 CH3 domains comprising one or more AEM and/or Disulfide bond forming ("DiS") modifications relative to IgG1 CH3 having SEQ ID NO:27, 28, 29 or 30 (see Table 6 and FIG. 3).

SEQ ID NOs:99-132 are the aa sequences of exemplary IgG1 Fc regions comprising in a contiguous amino to carboxyl terminal order: (a) a hinge selected from the group consisting of an IgG1 hinge, an IgG1 hinge comprising one or more aa substitutions, and a partial IgG1 hinge; (b) an IgG1 CH2 domain with N297Q (SEQ ID NO:25); and (c) an IgG1 CH3 domain selected from the group consisting of SEQ ID NO:29 and SEQ ID NO:29 comprising one or more AEM and/or DiS modifications (FIG. 4). The hinge, CH2 and CH3 domains are covalently linked without intervening sequences. The SEQ ID NOs of each of the domains of SEQ ID NOs:99-132 are set forth in Table 8.

SEQ ID NOs:133-166 are the aa sequences of exemplary IgG1/IgG4 hybrid Fc regions comprising in a contiguous amino to carboxyl terminal order: (a) a hinge selected from the group consisting of an IgG1/IgG4 hybrid hinge, an IgG1/IgG4 hybrid hinge comprising one or more aa substitutions, and a partial IgG4 hinge; (b) an IgG4 CH2 domain with T299K (SEQ ID NO:26); and (c) an IgG1 CH3 domain selected from the group consisting of SEQ ID NO:29 and SEQ ID NO:29 comprising one or more AEM and/or DiS modifications. The hinge, CH2 and CH3 domains are covalently linked without intervening sequences. The SEQ ID NOs of each of the domains of SEQ ID NOs:133-166 are set forth in Table 9.

SEQ ID NO:167 is KSCDKT, which is an exemplary modified carboxyl terminal portion of an IgG1 CH3 domain that introduces a cysteine.

SEQ ID NO:168 is GEC, which is an exemplary modified carboxyl terminal portion of an IgG1 CH3 domain that introduces a cysteine.

SEQ ID NO:169 is the aa sequence of an exemplary non Gly-Ser TFc linker SEQ ID NOs:170-195 are nucleotide sequences (even numbers) and aa sequences (odd numbers) of exemplary IgG1 TFcs, which are set forth in FIG. 6. The SEQ ID NOs of the domains that constitute each of these IgG1 TFcs is set forth in Table 12.

SEQ ID NOs:196-221 are nucleotide sequences (even numbers) and aa sequences (odd numbers) of exemplary TFcs comprising hybrid IgG1/IgG4 Fc regions, which are set forth in FIG. 7. The SEQ ID NOs of the domains that constitute each of these hybrid TFcs is set forth in Table 13.

SEQ ID NOs:222-223 are the nucleotide and aa sequences, respectively, of the heavy chain Fab domain of anti-c-Met Ab 5D5, without signal peptide.

SEQ ID NOs:224-225 are the nucleotide and aa sequences, respectively, of the heavy chain of an IgG1 TFcBA comprising the anti-c-Met 5D5 VH domain, an IgG1 TFc (with AEM 1), and the panitumumab scFv (FIG. 9).

SEQ ID NOs:226-227 are the nucleotide and aa sequences, respectively, of the heavy chain of an IgG1/IgG4 hybrid TFcBA comprising the anti-c-Met 5D5 VH domain, an IgG1/IgG4 hybrid TFc (with AEM 1), and the panitumumab scFv (FIG. 9).

SEQ ID NOs:228-229 are the nucleotide and aa sequences, respectively, of the heavy chain of an IgG1/IgG4 hybrid TFcBA comprising the anti-c-Met 5D5 VH domain, an IgG1/IgG4 hybrid TFc (with AEM 1), and the panitumumab scFv (FIG. 9).

SEQ ID NOs:230 and 231 are the nucleotide and aa sequences, respectively, of a light chain comprising humanized 5D5 anti-c-Met VL domain and CL domain, for use, e.g., with a heavy chain comprising the humanized 5D5 anti-c-Met VH domain, e.g., a heavy chain comprising SEQ ID NO: 225, 227, 229, 244, or 343.

SEQ ID NOs:232 and 233 are the nucleotide and aa sequences of an anti-EGFR scFv comprising the variable regions of panitumumab (VECTIBIX).

SEQ ID NOs:234 and 235 are the nucleotide and aa sequences, respectively, shown in FIGS. 9 and 10, respectively, of the heavy chain of an anti-c-Met/anti-EGFR TFcBA comprising (a) the anti-c-Met variable domain from humanized 5D5; (b) a TFc with AEM 1 and DiS 2 (SEQ ID NO:181); and (c) an anti-EGFR scFv comprising the variable regions of panitumumab (VECTIBIX) (SEQ ID NO:233).

SEQ ID NOs:236 and 237 are the nucleotide and aa sequences, respectively, of an anti-EGFR scFv comprising the variable regions of Ab 2224.

SEQ ID NOs:238 and 239 are the nucleotide and aa sequences, shown in FIGS. 9 and 10, respectively, of the heavy chain of an anti-c-Met/anti-EGFR TFcBA comprising (a) the anti-c-Met variable domain from humanized 5D5; (b) a TFc with AEM 1 and DiS 2 (SEQ ID NO:181); and (c) an anti-EGFR scFv comprising the variable regions of Ab 2224 (SEQ ID NO:237).

SEQ ID NOs:240 and 241 are the nucleotide and aa sequences, respectively, of an exemplary signal peptide.

SEQ ID NOs:242 and 243 are the nucleotide and aa sequence, respectively, of an exemplary signal peptide.

SEQ ID NOs:244 and 245 are the nucleotide and aa sequences, respectively, of the anti-c-Met VH domain of 5D5 and CL domain with a signal peptide having SEQ ID NO:241.

SEQ ID NO:246 and 247 are the nucleotide and aa sequences of the light chain having SEQ ID NO:231 with a signal peptide having SEQ ID NO:243.

SEQ ID NOs:248-254 are the aa sequences of variant hinges described in the specification.

SEQ ID NO: 255 and 256 are the nucleotide and aa sequences, respectively, of the heavy chain Fab region of the anti-c-Met binding site 2 (SEQ ID NO:287) with the signal peptide consisting of SEQ ID NO:241 and shown in Example 3.

SEQ ID NOs:257 and 258 are the nucleotide and aa sequences, respectively, of an anti-EGFR scFv comprising the variable regions of humanized cetuximab H1L1.

SEQ ID NOs:259 and 260 are the nucleotide and aa sequences, shown in FIGS. 9 and 10, respectively, of the heavy chain of an anti-c-Met/anti-EGFR TFcBA comprising (a) the anti-c-Met variable domain from humanized 5D5; (b) a TFc with AEM 1 and DiS 2 (SEQ ID NO:181); and (c) an anti-EGFR scFv comprising the variable regions of humanized cetuximab H1L1 (SEQ ID NO:258).

SEQ ID NO:261 is the aa sequence of a full length wild type IgG1 CH2 domain.

SEQ ID NO:262 is the aa sequence of a full length wild type IgG4 CH2 domain.

SEQ ID NOs:263, 264 and 265 are aa sequences of variant hIgG1 hinges (FIG. 2).

SEQ ID NO:266 is the aa sequence of the wild type mouse IgG1 hinge (FIG. 2).

SEQ ID NO:267 is the aa sequence of a mouse IgG1/IgG2A hybrid hinge (FIG. 2).

SEQ ID NOs:268 and 269 are the aa sequences of variant hIgG2 hinges (FIG. 2).

SEQ ID NO:270 is the aa sequence of a wild type hIgA2 hinge (FIG. 2).

SEQ ID NOs:271-273 are aa sequences of variant hIgA2 hinges (FIG. 2).

SEQ ID NOs:274-279 are nucleotide (even numbers) and aa (odd numbers) sequences of scFvs comprising variable domains of humanized cetuximab Abs H1L2, H2L1 and H2L2, which are described in Example 3.

SEQ ID NOs:280-285 are nucleotide (even numbers) and aa (odd numbers) sequences of the heavy chain of an anti-c-Met/anti-EGFR TFcBA comprising (a) the anti-c-Met variable domain from humanized 5D5; (b) an anti-EGFR scFv comprising the variable regions of humanized cetuximab Abs H1L2, H2L1 and H2L2 (SEQ ID NO:275, 277 or 279, respectively); and (c) a TFc with AEM 1 and DiS 2 (SEQ ID NO:181) (FIG. 9).

SEQ ID NOs:286 and 287 are the nucleotide and aa sequences, respectively, of the heavy chain Fab domain of anti-c-Met binding site 2, which is described in Example 3.

SEQ ID NOs:288 and 289 are the nucleotide and aa sequences, respectively, of the light chain Fab domain of anti-c-Met binding site 2, which is described in Example 3.

SEQ ID NOs:290 and 291 are the nucleotide and aa sequences, shown in FIGS. 9 and 10, respectively, of the heavy chain of an anti-c-Met/anti-EGFR TFcBA comprising (a) the anti-c-Met heavy chain Fab domain from anti-c-Met binding site 2 (SEQ ID NO:287); (b) a TFc with AEM 1 and DiS 2 (SEQ ID NO:181); and (c) an anti-EGFR scFv comprising the variable regions of humanized cetuximab H1L1 (SEQ ID NO:258) (FIG. 9). The aa sequence of SEQ ID NO:291 is the same as that having SEQ ID NO:260, wherein the anti-c-Met binding domain has been replaced with that of the anti-c-Met binding site 2.

SEQ ID NOs: 292-341 are nucleotide (even numbers) and aa (odd numbers) sequences of TFcs used in Examples 1 and 2 and shown in FIG. 11.

SEQ ID NOs: 342 and 343 are the nucleotide and aa sequences, respectively, of the heavy chain of an IgG1 TFcBA comprising the anti-c-Met 5D5 VH domain, an IgG1 TFc (with AEM 1 and DiS inverted), and the panitumumab scFv (FIG. 9).

SEQ ID NO: 344 and 345 are the nucleotide and aa sequences, respectively, of the light chain Fab region of the anti-c-Met binding site 2 (SEQ ID NO:289) with the signal peptide consisting of SEQ ID NO:243 and shown in Example 3.

SEQ ID NOs: 346 and 347 are the nucleotide and aa sequences, respectively, of the heavy chain of anti-c-met/anti-EGFR TFcBA with humanized 5D5 anti-c-Met and anti-EGFR panitumumab scFv with IgG1 TFc (with AEM 1 and a 40aa TFc linker having SEQ ID NO:169; FIG. 9).

SEQ ID NOs: 348 and 349 are the nucleotide and aa sequences, respectively, of the heavy chain of anti-c-met/anti-EGFR TFcBA with humanized 5D5 anti-c-Met and anti-EGFR panitumumab scFv with IgG1/IgG4 hybrid TFc (with AEM 1 and a 40aa TFc linker having SEQ ID NO:169; FIG. 9).

SEQ ID NO: 350 is the aa sequence of the heavy chain of anti-RON/anti-EGFR TFcBA comprising an anti-RON heavy chain Fab domain, anti-EGFR scFv 2224, and TFc 23E (SEQ ID NO:303); FIG. 14.

SEQ ID NO: 351 is the aa sequence of the heavy chain of the anti-RON/anti-EGFR TFcBA comprising an anti-RON heavy chain Fab domain, anti-EGFR scFv 2224, and TFc 39Egy4 (39E glycoform 4) (SEQ ID NO: 394); FIG. 14.

SEQ ID NO: 352 is the aa sequence of the heavy chain of the anti-RON/anti-CEA TFcBA comprising an anti-RON heavy chain Fab domain, anti-CEA scFv, and Tfc 23E (SEQ ID NO: 303); FIG. 14.

SEQ ID NO: 353 is the aa sequence of the heavy chain of the anti-RON/anti-CEA TFcBA comprising an anti-RON heavy chain Fab domain, anti-CEA scFv, and TFc 39Egy4 (SEQ ID NO: 394); FIG. 14.

SEQ ID NO: 354 is the aa sequence of the heavy chain of the anti-CEA/anti-cMet TFcBA comprising an anti-CEA heavy chain Fab domain, anti-cMet scFv, and TFc 23E (SEQ ID NO: 303); FIG. 14.

SEQ ID NO: 355 is the aa sequence of the heavy chain of the anti-CEA/anti-RON TFcBA comprising an anti-CEA heavy chain Fab domain, anti-RON scFv, and TFc 23E (SEQ ID NO: 303); FIG. 14.

SEQ ID NO: 356 is the aa sequence of the heavy chain of the anti-CEA/anti-scMet TFcBA comprising an anti-CEA heavy chain Fab domain, anti-cMet scFv, and TFc 39Egy4 (SEQ ID NO: 394); FIG. 14.

SEQ ID NOs 357-358 are the aa sequence and nucleotide sequence of TFc wild-type CH2 sequence; and T366S/L368A/Y407V/CH3 C-terminal Cysteine KSCDKT::T366W/CH3 C-terminal Cysteine GEC in the CH3 domains; FIG. 17 ("KSCDKT" and "GEC" disclosed as SEQ ID NOS 167 and 168, respectively).

SEQ ID NO: 359 is the aa sequence of the heavy chain of the anti-cMet/anti-CEA TFcBA comprising an anti-cMet heavy chain Fab domain, anti-CEA scFv, and TFc 23E (SEQ ID NO: 303); FIG. 14.

SEQ ID NO: 360 is the aa sequence of the heavy chain of the anti-cMet/anti-CEA TFcBA comprising an anti-cMet heavy chain Fab domain, anti-CEA scFv, and TFc 39Egy4 (SEQ ID NO: 394); FIG. 14.

SEQ ID NO: 361 is the aa sequence of the heavy chain of the anti-cMet/anti-CEA CD44 comprising an anti-cMet heavy chain Fab, an anti-CD44 scFv, and TFc 39Egy4 (SEQ ID NO: 394); FIG. 14.

SEQ ID NO: 362 is the aa sequence of the heavy chain of the anti-cMet/anti-CEA CD44 comprising an anti-cMet heavy chain Fab domain, an anti-CD44 scFv, and TFc 23E (SEQ ID NO: 303); FIG. 14.

SEQ ID NO: 363 is the aa sequence of the heavy chain of the anti-cMet/anti-CEA CD44 comprising an anti-cMet heavy chain Fab domain, an anti-CD44 scFv, and TFc 23E (SEQ ID NO: 303); FIG. 14.

SEQ ID NO: 364 is the aa sequence of the heavy chain of the anti-cMet/anti-CEA CD44 comprising an anti-cMet heavy chain Fab domain, an anti-CD44 scFv, and TFc 39Egy4 (SEQ ID NO: 394), FIG. 14.

SEQ ID NO: 365 is the aa sequence of the heavy chain of the anti-CD44/anti-anti-cMet comprising an anti-CD44 heavy chain Fab domain, an anti-cMet scFv, and TFc 23E (SEQ ID NO: 303); FIG. 14.

SEQ ID NO: 366 is the aa sequence of the heavy chain of the anti-CD44/anti-cMet comprising an anti-CD44 heavy chain Fab domain, an anti-cMet scFv, and TFc 39Egy4 (SEQ ID NO: 394); FIG. 14.

SEQ ID NO: 367 is the aa sequence of the anti-CD44 ARH60-16-2 light chain.

SEQ ID NOs 368-369 are the aa sequence and nucleotide sequence of the anti-cMet antibody onartuzumab and TFc 23 light chain; FIG. 14.

SEQ ID NOs 370-371 are the aa sequence and nucleotide sequence of the anti-cMet antibody onartuzumab and TFc 39 heavy chain; FIG. 14.

SEQ ID NOs 372-373 are the aa sequence and nucleotide sequence of the anti-cMet antibody onartuzumab and TFc 23E heavy chain; FIG. 14.

SEQ ID NOs 374-375 are the aa sequence and nucleotide sequence of the anti-cMet antibody onartuzumab and TFc 39Egy4 heavy chain; FIG. 14.

SEQ ID NOs 376-377 are the aa sequence and nucleotide sequence of anti-cMet/anti-EGFR comprising an anti-cMet heavy chain Fab domain, the cetuximab anti-EGFR scFv, and TFc 23E (SEQ ID NO: 303); FIG. 14.

SEQ ID NOs 378-379 are the aa sequence and nucleotide sequence of anti-cMet/anti-EGFR comprising an anti-cMet heavy chain Fab domain, the panitumumab anti-EGFR scFv, and TFc 23E (SEQ ID NO: 303); FIG. 14.

SEQ ID NOs 380-381 are the aa sequence and nucleotide sequence of anti-cMet/anti-EGFR comprising an anti-cMet heavy chain Fab domain, the 2224 anti-EGFR scFv, and TFc 23E (SEQ ID NO: 303); FIG. 14.

SEQ ID NOs 382-383 are the aa sequence and nucleotide sequence of anti-cMet/anti-EGFR comprising an anti-cMet heavy chain Fab domain the cetuximab anti-EGFR scFv, and TFc 39Egy4 (SEQ ID NO: 394); FIG. 14.

SEQ ID NOs 384-385 are the aa sequence and nucleotide sequence of anti-cMet/anti-EGFR comprising an anti-cMet heavy chain Fab domain, the panitumumab anti-EGFR scFv, and TFc 39Egy4 (SEQ ID NO: 394); FIG. 14.

SEQ ID NOs 386-387 are the aa sequence and nucleotide sequence of anti-cMet/anti-EGFR comprising an anti-cMet heavy chain Fab domain, the 2224 anti-EGFR scFv, and TFc 39Egy4 (SEQ ID NO: 394); FIG. 14.

For the sequences disclosed in FIG. 17, the double underline is the hinge, the single underline is the CH3 domain, the second double underline is the second hinge, the second underline is the second $CH_3$.

SEQ ID NOs 388-389 are the aa sequence and nucleotide sequence of glycosylation mutant 1, comprising N297D/T299S::N297D/T299S amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS 167 and 168, respectively); FIG. 17 SEQ ID NOs 390-391 are the aa sequence and nucleotide sequence of glycosylation mutant 2, comprising T299K::N297D/T299S amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS167 and 168, respectively); FIG. 17.

SEQ ID NOs 392-393 are the aa sequence and nucleotide sequence of glycosylation mutant 3, comprising N297D/T299S::T299K amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS 167 and 168, respectively); FIG. 17.

SEQ ID NOs 394-395 are the aa sequence and nucleotide sequence of glycosylation mutant 4, comprising T299K::T299D amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS 167 and 168, respectively); FIG. 17.

SEQ ID NOs 396-397 are the aa sequence and nucleotide sequence of glycosylation mutant 5, comprising T299D::T299K amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS 167 and 168, respectively); FIG. 17.

SEQ ID NOs 398-399 are the aa sequence and nucleotide sequence of glycosylation mutant 6, comprising T299D::T299D amino acid changes in the CH2 domains (underlined, bold-face), and T366S/L368A/Y407V/CH3 C-terminal Cysteine KSCDKT::T366W/CH3 C-terminal Cysteine GEC in the CH3 domains ("KSCDKT" and "GEC" disclosed as SEQ ID NOS 167 and 168, respectively); FIG. 17.

SEQ ID NOs 400-489 are described below.

DETAILED DESCRIPTION

Provided herein are Tandem Fc Antibodies ("TFcAs"), e.g., Tandem Fc Bispecific Antibodies ("TFcBAs"). The molecules may be used for treating a cell proliferative disorder, e.g., a cancer.

Definitions

For convenience, the meaning of certain terms and phrases used in the specification, examples, and appended claims, are provided below.

"aa modification" or "aa change" refers to one or more amino acid (aa) deletion, addition or substitution to an aa sequence. Aa sequence insertions include amino- and/or carboxyl-terminal fusions ranging in length from one residue to polypeptides containing a hundred or more residues, as well as intrasequence insertions of single or multiple aa residues. Intrasequence insertions may range generally from about 1 to 10 residues, e.g., 1 to 5, e.g., 1 to 3.

"AEM" or "association enhancing modification" refers to an aa modification made to a CH3 domain to enhance its association with another CH3 domain. An AEM may comprise one or more aa substitutions, deletions or additions in one or both Fcs of a TFc. AEMs are classified in modules, e.g., module 1 ("AEM 1"), wherein the modification to one of the two CH3 domains is referred to as AEM 1.1 and the modification to the other CH3 domain is referred to as AEM 1.2. For example, AEM 1.1 consists of the combination of substitutions T366S/L368A and Y407V and AEM 1.2 consists of the aa substitution T366W. When a CH3 domain comprises two or more aa modifications, e.g., aa substitutions, the modifications are separated from each other by a "/". When referring to modifications in two CH3 domains, the modifications in each of the CH3 domains are separated by "::".

An "anti-c-Met binding site" refers to a binding site that binds specifically to human c-Met.

An "anti-EGFR binding site" refers to a binding site that binds specifically to human EGFR.

"Antigen binding site" refers to a binding site that comprises the VH and/or VL domain of an antibody, or at least one CDR thereof, provided that the antigen binding site binds specifically to its target antigen. For example, an antigen binding site may comprise, consist essentially of, or consist of a VHCDR3 alone or together with a VHCDR2 and optionally a VHCDR1. In certain embodiments, an antigen binding site comprises a VH domain and a VL domain, which may be present on the same polypeptide or on two different polypeptides, e.g., the VH domain is present on a heavy chain and a VL domain is present on a light chain.

"Antigen-binding portion" of an antibody refers to one or more fragments of an antibody that retain the ability to specifically bind to an antigen (e.g., c-met or EGFR). It has been shown that the antigen-binding function of an antibody can be retained by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a $F(ab')_2$ fragment, a bivalent fragment comprising two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment which consists of a VH domain; and (vi) an isolated Complementarity Determining Region ("CDR"). Furthermore, although VL and VH are two domains of an Fv fragment, VL and VH are coded for by separate genes, they can be joined, using recombinant methods, by a synthetic linker that enables them to be made as a single protein chain in which the VL and VH regions pair to form monovalent proteins, known as single chain Fvs (scFvs) (see, e.g., U.S. Pat. No. 5,892,019). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites.

"Binding affinity" refers to the strength of a binding interaction and includes both the actual binding affinity as well as the apparent binding affinity. The actual binding affinity is a ratio of the association rate over the disassociation rate. The apparent affinity can include, for example, the avidity resulting from a polyvalent interaction. Dissociation constant (Kd), is typically the reciprocal of the binding affinity, and may be conveniently measured using a surface plasmon resonance assay (e.g., as determined using a ForteBio Octet platform (Pall ForteBio Corp.) or a BIACORE 3000 instrument (GE Healthcare) e.g., using recombinant c-Met as the analyte and an anti-c-Met antibody as the ligand) or a cell binding assay, examples of which assays is described in Example 3 of U.S. Pat. No. 7,846,440.

"Binding moiety," "binding domain," or "binding site," refers to the portion, region, or site of a binding polypeptide or, when so specified, of a heavy or light chain thereof, that is directly involved in mediating the specific binding of an antibody to a target molecule (i.e., an antigen). Exemplary binding domains include an antigen binding site, a receptor binding domain of a ligand, a ligand binding domain of a receptor or an enzymatic domain. In preferred embodiments, the binding domain comprises or consists of an antigen binding site (e.g., comprising a variable heavy (VH) chain sequence and variable light (VL) chain sequence or six CDRs from an antibody placed into alternative framework regions (e.g., human framework regions optionally comprising one or more aa substitutions). In certain embodiments, a binding site may be comprised essentially only of a VH or a VL chain sequence. A binding site may be entirely from one species, e.g., it has only sequences that derive from the germline sequences of one species. For example, a binding site may be human (i.e., from the human species), mouse, or rat. A binding site may also be humanized, i.e., the CDRs are from one species and the frameworks (FRs) are from another species. For example, a binding site may have CDRs that were derived from a mouse antibody and FRs that are from the human species. Certain humanized binding sites comprise mutations in one or more CDR to make the CDRs look more like the CDRs of the donor antibody. Certain humanized antibodies may also comprise mutations in one or more FR. Generally mutations in a binding site may enhance the affinity of binding of the binding site to its target antigen, and/or they may stabilize the binding site, e.g., to extend its half-life.

"CDR" or "complementarity determining region" refers to the noncontiguous antigen combining sites found within the variable region of both heavy and light chain polypeptides. These particular regions have been described by Kabat et al., J. Biol. Chem. 252, 6609-6616 (1977) and Kabat et al., Sequences of protein of immunological interest. (1991), and by Chothia et al., J. Mol. Biol. 196:901-917 (1987) and by MacCallum et al., J. Mol. Biol. 262:732-745 (1996) where the definitions include overlapping or subsets of aa residues when compared against each other. The aa residues which encompass the CDRs as defined by each of the above cited references are set forth for comparison. As used herein, and if not otherwise specified, "CDR" is as defined by Kabat. When CDRs (e.g., VH or VL CDRs) are described within larger sequences herein, they are always arranged in N-terminal to C-terminal order as CDR1, CDR2, CDR3, and are separated by framework amino acid sequences.

TABLE 1

CDR definitions

| | CDR Definitions | | |
|---|---|---|---|
| | Kabat[1] | Chothia[2] | MacCallum[3] |
| VHCDR1 | 31-35 | 26-32 | 30-35 |
| VHCDR2 | 50-65 | 53-55 | 47-58 |
| VHCDR3 | 95-102 | 96-101 | 93-101 |
| VLCDR1 | 24-34 | 26-32 | 30-36 |
| VLCDR2 | 50-56 | 50-52 | 46-55 |
| VLCDR3 | 89-97 | 91-96 | 89-96 |

[1]Residue numbering follows the nomenclature of Kabat et al., 1991, supra
[2]Residue numbering follows the nomenclature of Chothia et al., supra
[3]Residue numbering follows the nomenclature of MacCallum et al., supra "CH1 domain" refers to the heavy chain immunoglobulin constant domain located between the VH domain and the hinge. It spans EU positions 118-215. A CH1 domain may be a naturally occurring CH1 domain, or a naturally occurring CH1 domain in which one or more amino acids ("aas") have been substituted, added or deleted, provided that the CH1 domain has the desired biological properties. A desired biological activity may be a natural biological activity, an enhanced biological activity or a reduced biological activity relative to the naturally occurring sequence.

"CH2 domain" refers to the heavy chain immunoglobulin constant domain that is located between the hinge and the CH3 domain. As defined here, it spans EU positions 237-340. A CH2 domain may be a naturally occurring CH2 domain, or a naturally occurring CH2 domain in which one or more aas have been substituted, added or deleted, provided that the CH2 domain has the desired biological properties. A desired biological activity may be a natural biological activity, an enhanced biological activity or a reduced biological activity relative to that of the naturally occurring domain.

"CH3 domain" refers to the heavy chain immunoglobulin constant domain that is located C-terminally of the CH2 domain and spans approximately 110 residues from the N-terminus of the CH2 domain, e.g., about positions 341-446b (EU numbering system). A CH3 domain may be a naturally occurring CH3 domain, or a naturally occurring CH3 domain in which one or more aas have been substituted, added or deleted, provided that the CH3 domain has the desired biological properties. A desired biological activity may be a natural biological activity, an enhanced biological activity or a reduced biological activity relative to that of the naturally occurring domain. A CH3 domain may or may not comprise a C-terminal lysine.

"CH4 domain" refers to the heavy chain immunoglobulin constant domain that is located C-terminally of the CH3 domain in IgM and IgE antibodies. A CH4 domain may be a naturally occurring CH4 domain, or a naturally occurring CH4 domain in which one or more aas have been substituted, added or deleted, provided that the CH4 domain has the desired biological properties. A desired biological activity may be a natural biological activity, an enhanced biological activity or a reduced biological activity relative to that of the naturally occurring domain.

"CL domain" refers to the light chain immunoglobulin constant domain that is located C-terminally to the VL domain. It spans about Kabat positions 107A-216. A CL domain may be a naturally occurring CL domain, or a naturally occurring CL domain in which one or more aas have been substituted, added or deleted, provided that the CL domain has the desired biological properties. A desired biological activity may be a natural biological activity, an enhanced biological activity or a reduced biological activity relative to that of the naturally occurring domain. A CL domain may or may not comprise a C-terminal lysine.

"c-Met" or "c-MET" refers to Mesenchymal-Epithelial Transition (MET) factor, which is also known as Hepatocyte Growth Factor Receptor (HGFR), Scatter Factor (SF) receptor, AUTS9, RCCP2, corresponds to Gene ID 4233, and has tyrosine-kinase activity. The primary single chain precursor protein is post-translationally cleaved to produce the alpha and beta subunits, which are disulfide linked to form the mature receptor. Two transcript variants encoding different isoforms have been found for this gene. HGF is the only known ligand for c-Met. The aa sequence of the human c-Met isoform a precursor is provided at Genbank Accession No. NP_001120972.1 and isoform b precursor is provided at Genbank Accession No. NP_000236.2.

A "constant region" or domain of a light chain of an immunoglobulin is referred to interchangeably as a "CL," "light chain constant region domain," "CL region" or "CL domain." A constant domain on a heavy chain (e.g. hinge, CH1, CH2 or CH3 domains) of an immunoglobulin is referred to interchangeably as a "CH," "heavy chain constant domain," "CH" region or "CH domain." A variable domain on an immunoglobulin light chain is referred to interchangeably as a "VL," "light chain variable domain," "VL region" or "VL domain." A variable domain on an immunoglobulin heavy chain is referred to interchangeably as a "VH," "heavy chain variable domain," "VH region" or "VH domain."

"DiS" refers to the modification of a domain, e.g., a hinge or CH3 domain, that results in the addition of a Cysteine, which can form a disulfide bond with another Cysteine. A DiS may comprise one or more aa substitutions, deletions or additions in one or both Fcs of a TFc. DiSs are classified in modules, e.g., module 1 ("DiS 1"), wherein the modification to one of the two Fcs is referred to as DiS 1.1 and the modification to the other Fc is referred to as DiS 1.2. For example, DiS 1.1 consists of the substitution Y349C and DiS 1.2 consists of the aa substitution S354C.

"Domain" refers generally to a region, e.g., an independently folding, globular region or a non-globular region (e.g., a linker domain), of a heavy or light chain polypeptide which may comprise peptide loops (e.g., 1 to 4 peptide loops) that may be stabilized, for example, by a β-pleated sheet and/or an intrachain disulfide bond. The constant and variable regions of immunoglobulin heavy and light chains are typically folded into domains. In particular, each one of the CH1, CH2, CH3, CH4, CL, VH and VL domains typically form a loop structure.

"$EC_{50}$" or "EC50" refers to the concentration of a molecule, e.g., a TFcA, that provides 50% of the maximal effect of the protein on a particular system such as a binding assay or a signal transduction pathway.

"EGFR" refers to Epidermal Growth Factor Receptor, which is also known as ErbB1, HER-1, mENA, and PIG61. EGFR is known to bind ligands including epidermal growth factor (EGF), transforming growth factor α (TGf-α), amphiregulin, heparin-binding EGF (hb-EGF), betacellulin, epiregulin and has Gene ID 1956 (Herbst, R. S., and Shin, D. M., Cancer 94 (2002) 1593-1611; Mendelsohn, J., and Baselga, J., Oncogene 19 (2000) 6550-6565). EGFR is transmembrane glycoprotein that is a member of the protein kinase superfamily that regulates numerous cellular processes via tyrosine-kinase mediated signal transduction pathways, including, but not limited to, activation of signal transduction pathways that control cell proliferation, differentiation, cell survival, apoptosis, angiogenesis, mitogenesis, and metastasis (Atalay, G., et al., Ann Oncology 14 (2003) 1346-1363; Tsao, A. S., and Herbst, R. S., Signal 4 $(2003)_{4-9}$; Herbst, R. S., and Shin, D. M., Cancer 94 (2002) 1593-1611; Modjtahedi, H., et al., Br. J. Cancer 73 (1996) 228-235). Binding of the ligand to EGFR induces receptor dimerization and tyrosine autophosphorylation, which leads to cell proliferation. Multiple alternatively spliced transcript variants that encode different protein isoforms have been found for this gene. The aa sequences for human EGFR isoforms a-d precursors are provided at Genbank Accession Nos. NP_005219.2, NP_958439.1, NP_958440.1 and NP_958441.1.

"EpCAM" refers to epithelial cell adhesion molecule, a protein that in humans is encoded by the EPCAM gene. EpCAM has also been designated as TACSTD1 (tumor-associated calcium signal transducer 1), CD326 (cluster of differentiation 326) and the 17-1A antigen. EpCAM is a pan-epithelial differentiation antigen that is expressed by most carcinomas.

"ErbB2" or "HER2" refers to a putative tyrosine kinase growth factor receptor EGFR2, p185 HER2/NEU antigen, similar to the EGF receptor. The aa sequences for ErbB2 isoforms are provided at Genbank Accession Nos. NP_004439.2 and NP_001005862.1, and the nucleotide sequence has GeneID 2064.

"ErbB3" or "HER3" refers to a receptor tyrosine-protein kinase that is encoded by the human ERBB3 gene and has a role in protein amino acid phosphorylation. The aa sequences for ErbB3 isoforms are provided at Genbank Accession Nos. NP001973.2 and NP_001005915.1, and the nucleotide sequence has GeneID 2065.

"ErbB4" or "HER4" plays a role in receptor tyrosine kinase signal transduction that regulates cellular proliferation and differentiation. The aa sequences for ErbB3 isoforms are provided at Genbank Accession Nos. NP001973.2 and NP_001005915.1, and the nucleotide sequence has GeneID 2066.

The ERBB2, ERBB3, and ERBB4 genes encode heregulin/neuregulin receptors, members of the EGFR-related type I receptor tyrosine kinase subfamily. The encoded proteins form homo- and heterodimers, which complicates assignment of function: ERBB2 homodimers do not bind heregulin, but ERBB2/ERBB3 heterodimers do. Herstatin is a secreted alternative ERBB2 product, of the extracellular domain, that binds to p185ERBB2, disrupts ERBB2 dimers, reduces p185 phosphorylation, and inhibits growth. Human ERBB2 gene is located at 17p12-21. Overexpression of HER-2 correlates with poor prognosis in breast carcinoma.

"IGF1R" refers to the insulin-like growth factor 1 receptor. Exemplary human IGF1R nucleic acid and protein sequences are set forth in RefSeqGene Gene ID: 3480 and GenBank Accession Number: NP_000866.1, respectively.

"IGF2R" refers to the insulin-like growth factor 2 receptor. Exemplary human IGF2R nucleic acid and protein sequences are set forth in RefSeqGene Gene ID: 3482 and GenBank Accession Number: NP_000867.2, respectively.

"Insulin receptor" refers to the cellular receptor for insulin. Exemplary human insulin receptor nucleic acid and protein sequences are set forth in RefSeqGene Gene ID: 3643 and GenBank Accession Number: NP_000199.2, respectively.

"RON" refers to the receptor for Macrophage-stimulating protein receptor. Exemplary human RON nucleic acid and protein sequences are set forth in RefSeqGene Gene ID: 4486 and GenBank Accession Number: NP_002438.2, respectively.

"c-Kit" refers to v-kit Hardy-Zuckerman 4 feline sarcoma viral oncogene homolog. Exemplary human c-Kit nucleic acid and protein sequences are set forth in RefSeqGene Gene ID: 3815 and GenBank Accession Number: NP_001087241.1, respectively.

"VEGFR1" refers to vascular endothelial growth factor 1. Exemplary human VEGFR1 nucleic acid and protein sequences are set forth in RefSeqGene Gene ID: 2321 and GenBank Accession Number: NP_002010.2, respectively.

"VEGFR2" refers to vascular endothelial growth factor 2. Exemplary human VEGFR2 nucleic acid and protein sequences are set forth in RefSeqGene Gene ID: 3791 and GenBank Accession Number: NP_002244.1, respectively.

"TNFR" refers to tumor necrosis factor receptor. Exemplary human TNFR nucleic acid and protein sequences are set forth in RefSeqGene Gene ID: 7132 and GenBank Accession Number: NP_001056.1, respectively.

"FGFR1" refers to fibroblast growth factor receptor 1. Exemplary human FGFR1 nucleic acid and protein sequences are set forth in RefSeqGene Gene ID: 2260 and GenBank Accession Number: NP_001167537.1, respectively.

"FGFR2" refers to fibroblast growth factor receptor 2. Exemplary human FGFR2 nucleic acid and protein sequences are set forth in RefSeqGene Gene ID: 2263 and GenBank Accession Number: NP_001138390.1, respectively.

"FGFR3" refers to fibroblast growth factor receptor 3. Exemplary human FGFR3 nucleic acid and protein sequences are set forth in RefSeqGene Gene ID: 2261 and GenBank Accession Number: NP_000133.1, respectively.

"FGFR4" refers to fibroblast growth factor receptor 4. Exemplary human FGFR4 nucleic acid and protein sequences are set forth in RefSeqGene Gene ID: 2264 and GenBank Accession Number: NP_075252.2, respectively.

"PDGFR-alpha" refers to platelet-derived growth factor receptor alpha. Exemplary human PDGFR-alpha nucleic acid and protein sequences are set forth in RefSeqGene Gene ID: 5156 and GenBank Accession Number: NP_006197.1, respectively.

"PDGFR-beta" refers to platelet-derived growth factor receptor beta. Exemplary human PDGFR-beta nucleic acid and protein sequences are set forth in RefSeqGene Gene ID: 5159 and GenBank Accession Number: NP_002600.1, respectively.

"EpCAM" refers to epithelial cell adhesion molecule. Exemplary human EpCAM nucleic acid and protein sequences are set forth in RefSeqGene Gene ID: 4072 and GenBank Accession Number: NP_002345.2, respectively.

"EphA2" refers to EPH receptor A2. Exemplary human EphA2 nucleic acid and protein sequences are set forth in RefSeqGene Gene ID: 1969 and GenBank Accession Number: NP_004422.2, respectively.

"CEA" refers to carcinoembryonic antigen-related cell adhesion molecule 5. Exemplary human CEA nucleic acid and protein sequences are set forth in RefSeqGene Gene ID: 1048 and GenBank Accession Number: NP_004354.2, respectively.

"CD44" refers to the cell-surface glycoprotein CD44. Exemplary human CD44 nucleic acid and protein sequences are set forth in RefSeqGene Gene ID: 960 and GenBank Accession Number: NP_001189486.1, respectively.

"ALK" refers to the anaplastic lymphoma receptor tyrosine kinase. Exemplary human ALK nucleic acid and protein sequences are set forth in RefSeqGene Gene ID: 238 and GenBank Accession Number: NP_004295.2, respectively.

"AXL" refers to the AXL receptor tyrosine kinase. Exemplary human AXL nucleic acid and protein sequences are set forth in RefSeqGene Gene ID: 558 and GenBank Accession Number: NP_068713.2, respectively.

"EU" indicates that aa positions in a heavy chain constant region, including aa positions in the CH1, hinge, CH2, and CH3 domains, are numbered herein according to the EU index numbering system (see Kabat et al., in "Sequences of Proteins of Immunological Interest", U.S. Dept. Health and Human Services, $5^{th}$ edition, 1991).

"Fab" refers to the antigen binding portion of an antibody, comprising two chains: a first chain that comprises a VH domain and a CH1 domain and a second chain that comprises a VL domain and a CL domain. Although a Fab is typically described as the N-terminal fragment of an antibody that was treated with papain and comprises a portion of the hinge region, it is also used herein as referring to a binding domain wherein the heavy chain does not comprise a portion of the hinge.

"Fc region" refers to the portion of a single immunoglobulin heavy chain beginning in the hinge region just upstream of the papain cleavage site (i.e. residue 216 in IgG, taking the first residue of heavy chain constant region to be 114) and ending at the C-terminus of the antibody. Accordingly, a complete Fc region comprises at least a hinge, a CH2 domain, and a CH3 domain. Two Fc regions that are dimerized are referred to as "Fc" or "Fc dimer." An Fc region may be a naturally occurring Fc region, or a naturally occurring Fc region in which one or more aas have been substituted, added or deleted, provided that the Fc region has the desired biological properties. A desired biological activity may be a natural biological activity, an enhanced biological activity or a reduced biological activity relative to that of the naturally occurring domain.

"Framework region" or "FR" or "FR region" includes the aa residues that are part of the variable region, but are not part of the CDRs (e.g., using the Kabat definition of CDRs). Therefore, a variable region framework is between about 100-120 aas in length but includes only those aas outside of the CDRs. For the specific example of a heavy chain variable region and for the CDRs as defined by Kabat et al., 1991, ibid., framework region 1 corresponds to the domain of the variable region encompassing aas 1-30; framework region 2 corresponds to the domain of the variable region encompassing aas 36-49; framework region 3 corresponds to the domain of the variable region encompassing aas 66-94, and framework region 4 corresponds to the domain of the variable region from aas 103 to the end of the variable region. The framework regions for the light chain are similarly separated by each of the light chain variable region CDRs. Similarly, using the definition of CDRs by Chothia et al. or McCallum et al. the framework region boundaries are separated by the respective CDR termini as described above. In preferred embodiments, the CDRs are as defined by Kabat.

"Full length antibody" or "full length Ab" is an antibody ("Ab") that comprises one or more heavy chains and one or more light chains, which optionally may be connected. Each heavy chain is comprised of a heavy chain variable region (abbreviated herein as VH) and a heavy chain constant region. The heavy chain constant region is comprised of three domains CH1, CH2, and CH3, and optionally a fourth domain, CH4. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is typically composed of three CDRs and four FRs, arranged from amino-terminus to carboxyl-terminus in the following order: FR1, CDR1, FR2, CDR2, FR3, CDR3, and FR4. Immunoglobulin proteins can be of any type or class (e.g., IgG, IgE, IgM, IgD, IgA and IgY) or subclass (e.g., IgG1, IgG2, IgG3, IgG4, IgA1 and IgA2).

"Gly-Ser linker" or "Gly-Ser peptide" refers to a peptide that consists of glycine and serine residues. An exemplary Gly-Ser peptide comprises the aa sequence (Gly4 Ser)n (SEQ ID NO: 493), wherein n=1, 2, 3, 4, 5, 6, 7, 8, 9, 10, 11, 12, 13, 14, 15, 16, 17, 18, 19, 20 or more. In certain embodiments, n is a number between 1 and 5, n is a number between 6 and 10, n is a number between 11 and 15, n is a number between 16 and 20, n is a number between 21 and 25, or n is a number between 26 and 30.

"Hinge" or "hinge region" or "hinge domain" refers to the flexible portion of a heavy chain located between the CH1 domain and the CH2 domain. It is approximately 25 aas long, and is divided into an "upper hinge," a "middle hinge" or "core hinge," and a "lower hinge." A hinge may be a naturally occurring hinge, or a naturally occurring hinge in which one or more aas have been substituted, added or deleted, provided that the hinge has the desired biological properties. A desired biological activity may be a natural biological activity, an enhanced biological activity or a reduced biological activity relative to the naturally occurring sequence.

A "hinge subdomain" refers to the upper hinge, middle (or core) hinge or the lower hinge. The aa sequences of the hinge subdomains of an IgG1, IgG2, IgG3 and IgG4 are set forth in Table 2:

TABLE 2

Listing of IgG hinge subdomains

| IgG | Upper hinge | Middle hinge | Lower hinge | Complete hinge |
|---|---|---|---|---|
| IgG1 | EPKSCDKTHT (SEQ ID NO: 1) | CPPCP (SEQ ID NO: 2) | APELLG (SEQ ID NO: 3) | SEQ ID NO: 4 |
| IgG2 | ERKCCVE (SEQ ID NO: 5) | CPPCP (SEQ ID NO: 2) | APPVAGP (SEQ ID NO: 6) | SEQ ID NO: 7 |
| IgG3 | ELKTPLGDTTHT (SEQ ID NO: 8) | $CPRCP(EPKSCDTPPPCPRCP)_3$ (SEQ ID NO: 9) | APELLG (SEQ ID NO: 10) | SEQ ID NO: 11 |
| IgG4 | ESKYGPP (SEQ ID NO: 12) | CPSCP (SEQ ID NO: 13) | APEFLG (SEQ ID NO: 14) | SEQ ID NO: 15) |

The complete hinge consists of the upper hinge subdomain, middle hinge subdomain and lower hinge subdomain in amino to carboxy terminal order and without intervening sequences.

"$IC_{50}$," or "IC50" refers to the concentration of a molecule, e.g., a TFcA, that provides a 50% inhibition of a maximal activity (e.g., a response to a stimulus or a constitutive activity), i.e., a concentration that reduces the activity to a level halfway between the maximal activity and the baseline. The $IC_{50}$ value may be converted to an absolute inhibition constant (Ki) using, e.g., the Cheng-Prusoff equation. In a system that is inhibited by a binding agent, such as an antibody or a TFcA provided herein, the IC50 may be indistinguishable from the EC50.

"Inhibition" of a biological activity by a binding protein refers to any reproducibly detectable decrease in biological activity mediated by the binding protein. In some embodiments, inhibition provides a statistically significant decrease in biological activity, e.g., a decrease of about 5%, 10%, 20%, 30%, 40%, 50%, 60%, 70%, 80%, 90%, or 100% in biological activity relative to the biological activity determined in the absence of the binding protein.

"Kabat" in conjunction with designation of immunoglobulin aa sequence positions indicates that amino acid positions in a light chain constant region (e.g. CL domain) are numbered according to the Kabat index numbering system (see Kabat et al., 1991., op. cit.).

"Linked to" refers to direct or indirect linkage or connection of, in context, amino acids or nucleotides. An "indirect linkage" refers to a linkage that is mediated through a linker or a domain, comprising, e.g., one or more aas or nucleotides. A "direct linkage" or "linked directly" when referring to two polypeptide segments refers to the presence of covalent bond between the two polypeptide segments, e.g., the two polypeptide segments are joined contiguously without intervening sequences.

"Linker" refers to one or more aas connecting two domains or regions together. A linker may be flexible to allow the domains being connected by the linker to form a proper three dimensional structure thereby allowing them to have the required biological activity. A linker connecting the VH and the VL of an scFv is referred to herein as an "scFv linker" A linker connecting the N-terminus of a VH domain or the C-terminus of the CH3 domain to a second VH or VL domain, e.g., that of an scFv, is referred to as a "connecting linker."

"Module" refers to a structurally and/or functionally distinct part of a TFcA, such a binding site (e.g., an scFv domain or a Fab domain) and the TFc. Modules provided herein can be rearranged (by recombining sequences encoding them, either by recombining nucleic acids or by complete or fractional de novo synthesis of new polynucleotides) in numerous combinations with other modules to produce a wide variety of TFcAs, e.g., as disclosed herein. "Module" is also used to refer to the type of AEM or DiS modifications. In this context, and as further described herein, a "module" is one or a combination of two or more aa substitutions, additions or deletions that are made to enhance or favor the association or dimerization of the Fc regions comprising these modifications.

"% identical" refers to two or more nucleic acid or polypeptide sequences or subsequences that are the same (100% identical) or have a specified percentage of nucleotide or aa residues that are the same, when the two sequences are aligned for maximum correspondence and compared. To align for maximum correspondence, gaps may be introduced into one of the sequences being compared. The aa residues or nucleotides at corresponding positions are then compared and quantified. When a position in the first sequence is occupied by the same residue as the corresponding position in the second sequence, then the sequences are identical at that position. The percent identity between the two sequences is a function of the number of identical positions shared by the sequences (e.g., % identity=# of identical positions/total # of positions (e.g., overlapping positions)×100). In certain embodiments, the two sequences are the same length. The determination that one sequence is a measured % identical with another sequence can be determined using a mathematical algorithm. A non-limiting example of a mathematical algorithm utilized for such comparison of two sequences is incorporated in the ALIGN program (version 2.0) which is part of the GCG sequence alignment software package. When utilizing the ALIGN program e.g., for comparing aa sequences, a PAM120 weight residue table, a gap length penalty of 12, and a gap penalty of 4 may be used. Additional algorithms for sequence analysis are well known in the art and many are available online "Portion" or "fragment" (e.g., of a domain) of a reference moiety refers to a discrete part of the whole reference moiety (e.g., domain, e.g., a naturally occurring domain) that is at least, or at most 10% 20%, 30%, 40%, 50%, 60%, 70%, 80%, 90%, 95%, 98%, or 99% of the size of the reference moiety.

"scFv linker" refers to a peptide or polypeptide domain interposed between the VL and VH domains of an scFv. scFv linkers preferably allow orientation of the VL and VH domains in a antigen binding conformation. In one embodiment, an scFv linker comprises or consists of a peptide or polypeptide linker that only comprises glycines and serines (a "Gly-Ser linker"). In certain embodiments, an scFv linker comprises a disulfide bond.

"Specific binding," "specifically binds," "selective binding," and "selectively binds," as well as "binds specifically" "binds selectively," when referring to the binding of a binding site to its target epitope or a combination of binding sites to their target epitopes, means that the binding site(s) exhibit(s) immunospecific binding to the target epitope(s). A binding site that binds specifically to an epitope exhibits appreciable affinity for a target epitope and, generally, does not exhibit cross-reactivity with other epitopes in that it does not exhibit appreciable affinity to any unrelated epitope and preferably does not exhibit affinity for any unrelated epitope that is equal to, greater than, or within two orders of magnitude lower than the affinity for the target epitope.

"Appreciable" or preferred binding includes binding with a dissociation constant (Kd) of $10^{-8}$, $10^{-9}$ M, $10^{-10}$, $10^{-11}$, $10^{-12}$ M, $10^{-13}$ M or an even lower Kd value. The Kd values can also be indicated as 10e-8, 10e-9 M, etc. Note that lower values for Kd (dissociation constant) indicate higher binding affinity, thus a Kd of $10^{-7}$ is a higher Kd value than a Kd of $10^{-8}$, but indicates a lower binding affinity than a Kd of $10^{-8}$. Dissociation constants with values of about $10^{-7}$M, and even as low as about $10^{-8}$ M, are at the high end of dissociation constants suitable for therapeutic antibodies. Binding affinities may be indicated by a range of dissociation constants, for example, $10^{-6}$ to $10^{-12}$ M, $10^{-7}$ to $10^{-12}$M, $10^{-8}$ to $10^{-12}$M or better (i.e., or lower value dissociation constant). Dissociation constants in the nanomolar ($10^{-9}$ M) to picomolar ($10^{-12}$ M) range or lower are typically most useful for therapeutic antibodies. Suitable dissociation constants are Kds of 50 nM or less (i.e., a binding affinity of 50 nM or higher—e.g., a Kd of 45 nM) or Kds of 40 nM, 30 nM, 20 nM, 10 nM, 1 nM, 100 μM, 10 μM or 1 μM or less. Specific or selective binding can be determined according to any art-recognized means for determining such binding, including, for example, according to Scatchard analysis and/or competitive binding assays.

A "TFc" or "tandem Fc" refers to an entity comprising in an amino to carboxyl terminal order: a first Fc region, which is linked at its C-terminus to the N-terminus of a TFc linker, which is linked at its C-terminus to the N-terminus of a second Fc region, wherein the first and the second Fc regions associate to form an Fc.

"TFcA" refers to a tandem Fc antibody. A TFcA may be a monovalent or monospecific TFcA, e.g., comprising a single binding site. A TFcA may also be a bispecific TFcA, which is referred to herein as a TFcBA. A TFcA may be monoclonal.

"TFcBA" refers to a tandem Fc bispecific antibody, an artificial hybrid protein comprising at least two different binding moieties or domains and thus at least two different binding sites (e.g., two different antibody binding sites), wherein one or more of the pluralities of the binding sites are covalently linked, e.g., via peptide bonds, to each other. An exemplary TFcBA described herein is an anti-c-Met+anti-EGFR TFcBA, which is a polyvalent bispecific antibody that comprises a first binding site binding specifically to a c-Met protein, e.g., a human c-Met protein, and one or more second binding sites binding specifically to an EGFR protein, e.g., a human EGFR protein. When a TFcBA name comprises two antigens separated by a plus sign (+) this indicates that the binding sites for the two antigens may be in either relative amino to carboxy orientation in the molecule, whereas when the TFcBA name comprises two antigen binding site names separated by a slash (/) the antigen binding site to the left of the slash is amino terminal to the antigen binding site to the right of the slash. A TFcBA may be a bivalent binding protein, a trivalent binding protein, a tetravalent binding protein or a binding protein with more than 4 binding sites. An exemplary TFcBA is a bivalent bispecific antibody, i.e., an antibody that has 2 binding sites, each binding to a different antigen or epitope. In certain embodiments, the N-terminal binding site of a TFcBA is a Fab and the C-terminal binding site is an scFv.

Tandem Fc Abs

Provided herein are Tandem Fc Antibodies ("TFcAs"), which may be monovalent or polyvalent, e.g., bivalent, trivalent, or tetravalent. TFcAs which are polyvalent may be monospecific, bispecific ("Tandem Fc Bispecific Abs" or "TFcBAs") trispecific or tetraspecific TFcBAs. When a TFcBA is multispecific, it may be monovalent for one or more specificities.

In certain embodiments, a TFcA is a TFcBA. Exemplary TFcBAs inhibit ligand-induced signal transduction through one or both of the receptors targeted by the TFcBA and may thereby inhibit tumor cell proliferation or tumor growth. TFcBAs may also induce receptor downregulation or block receptor dimerization. Exemplary anti c-Met/anti-EGFR TFcBAs comprise a single anti-c-Met binding site (monovalent for anti-c-Met) and one or more anti-EGFR binding sites (monovalent or polyvalent for anti-EGFR). A TFc typically comprises a first Fc region linked to a second Fc region through a TFc linker, wherein the first and the second Fc regions dimerize to form an Fc.

FIG. 1A and FIG. 1B show a diagram of an exemplary TFcBA showing the various elements of the molecule. As shown in FIG. 1A and FIG. 1B, a TFcBA comprises a first binding site (e.g., an anti-c-Met Fab), a second binding site (e.g., an anti-EGFR scFv), and a tandem Fc ("TFc") that links the first and the second binding sites together. A TFcBA may be described as containing three modules, wherein the first module comprises the first binding site, the second module comprises the TFc and the third module comprises the second binding site. A TFc generally comprises in a contiguous aa sequence a first Fc region, a TFc linker, and a second Fc region, wherein the TFc linker links the first Fc region to the second Fc region and allows the association of the two Fc regions. As illustrated in the exemplary TFcBA in FIG. 1A and FIG. 1B, each of the two Fc regions of a TFc may comprise a hinge, a CH2 domain and a CH3 domain. Each of these regions may be from the same immunoglobulin isotype, or from different isotypes. For example, the hinge, CH2 and CH3 domains may all be from IgG1, IgG2, IgG3 or IgG4, or certain domains or portions thereof may be from one immunoglobulin isotype and another domain or portion may be from another immunoglobulin isotype. For example, the TFcBA that is pictured in FIG. 1A and FIG. 1B comprises all domains from IgG1, or alternatively, it may comprise an IgG1/IgG4 hybrid hinge, an IgG4 CH2 domain and an IgG1 CH3 domain. An Fc region preferably comprises human Fc domains, however, sequences from other mammals or animals may also be used, provided that the TFcBA retains its biological activity and is preferably not significantly immunogenic in a human subject.

In preferred embodiments, the first and/or the second Fc region comprise one or more modifications to enhance their association and/or to stabilize such association. In certain embodiments, the first and/or the second CH3 domains of a TFcA comprises one or more modification to enhance the association of the CH3 domains or Fcs comprising such. Such modifications are referred to herein as Association Enhancing Modifications or "AEMs." Exemplary modifications include aa substitutions in both CH3 domains to enhance their interaction, e.g., knob/hole mutations.

In certain embodiments, the first and/or the second Fc region comprises an aa modification that results in the addition of one or more cysteines to the Fc region, to thereby form a disulfide bond with the other Fc region of the TFc. Such modifications are referred to herein as disulfide forming modifications or "DiS" modifications. DiS modifications may be present in the hinge, CH2 and/or CH3 domains.

A TFc may comprise one or more AEM and/or one or more DiS modifications. FIG. 1B shows exemplary modifications that can be made to either the CH3 region or the hinge. Fc regions may also comprise additional modifications, e.g., modifications that modulate a biological activity that is mediated through the Fc region, such as ADCC.

Although generally, the first and the second Fc regions comprise a hinge, a CH2 domain and a CH3 domain, in certain embodiments, an Fc region may comprise a CH3 domain and a CH2 domain, but no hinge. In other embodiments, an Fc region comprises a CH3 domain and a hinge, but does not comprise a CH2 domain. In other embodiments, an Fc region may comprise a CH3 domain and a CH4 domain, but does not comprise a CH2 domain nor a hinge. In other embodiments, an Fc region may comprise a CH3 domain, a CH4 domain, a CH2 domain, but does not comprise a hinge. In other embodiments, an Fc region may comprise a CH3 domain, a CH4 domain, a hinge, but does not comprise a CH2 domain. In certain embodiments, a portion of one or more domains is absent.

In certain embodiments, the first Fc region comprises an aa sequence that differs from that of the second Fc region in one or more aa addition, deletion or substitution (a "heterodimeric Fc"). This is often the case as AEM and DiS modifications, which typically introduce different modifications to the first and the second Fc region. In other embodiments, the first Fc region comprises the same aa sequence as the second Fc region (a "homodimeric Fc").

In certain embodiments, an Fc domain (hinge, CH2 or CH3 domain) is directly linked to another Fc domain. For example, a hinge may be directly linked to a CH2 domain and/or a CH2 domain may be directly linked to a CH3 domain. In other embodiments, an Fc domain is linked to another Fc domain through a linker, which may be one or more aas long, provided that the TFcA comprising these domains has the desired biological activity and stability and any other desired characteristics.

In certain embodiments, a binding site is an antigen binding site, which comprises, e.g., a heavy chain variable (VH) domain and a light chain variable (VL) domain. The VH and VL domains generally contain 3 Complementarity Determining Regions (CDRs) each, although in certain embodiments, fewer than 6 CDRs may be sufficient for providing specific binding to an antigen. In certain embodiments, the VH domain is part of a Fab, in which case, the VH domain is linked to a CH1 domain, generally in the natural order, i.e., the VH domain is linked to the N-terminus of the CH1. When the antigen binding site is part of a Fab, the VL domain may be linked to a light chain constant (CL) domain, generally in the natural order, i.e., the VL domain is linked to the N-terminus of the CL domain.

The variable domains (VH and VL) may be linked directly or indirectly to the constant domains (CH1 and CL), e.g., through a linker, which may be one or more aas long, provided that the TFcA comprising these domains has the desired biological activity and stability and any other desired characteristics.

In certain embodiments, the VH domain is part of an scFv, in which case, the VH domain is linked to the VL domain through an scFv linker, and the scFv is linked to the N- and/or C-terminus of a TFc. When a binding site is an scFv, the variable regions are generally not linked to a CH1 or CL domain.

In certain embodiments, a TFcA is monovalent and mono-specific. A monovalent TFcA may comprise a binding site at the amino terminus or at the C-terminus of the TFc. The binding site of a monovalent TFcA may be a Fab or an scFv. Exemplary heavy chains of monovalent TFcAs comprise in amino to carboxyl terminal order:

i) a VH domain and a TFc;

ii) a VH domain, a CH1 domain, and a TFc;

iii) a VH domain, an scFv linker, a VL domain, and a TFc;

iv) a TFc, a connecting linker and a VH domain;

v) a TFc, a connecting linker, a VH domain and a CH1 domain; and vi) a TFc, a connecting linker, a VH domain, an scFv linker and a VL domain.

When a TFcA comprises a Fab, the TFcA also comprises a light chain comprising the VL domain of the Fab and optionally a CL domain.

In certain embodiments, a TFcA is a TFcBA. TFcBAs may comprise one Fab binding specifically to a first antigen and a second Fab binding specifically to a second antigen. TFcBAs may also comprise a first scFv binding specifically to a first antigen and a second scFv binding specifically to a second antigen. TFcBAs may also comprise a Fab binding specifically to a first antigen and an scFv binding specifically to a second antigen. In certain embodiments, the amino terminus of a TFc is connected to a Fab and the carboxyl terminus of the TFc is connected to an scFv. Alternatively, the amino terminus of a TFc is connected to an scFv and the carboxyl terminus of the TFc is connected to a Fab. Exemplary molecules have the following format: Fab-TFc-scFv; Fab-TFc-Fab; scFv-TFc-scFv; and scFv-TFc-Fab.

In one embodiment, a TFcBA comprises a heavy chain, which comprises in amino to carboxyl-terminal order:

(i) a first VH domain, a TFc, a connecting linker, and a second VH domain;

(ii) a first VH domain, a CH1 domain, a TFc, a connecting linker, and a second VH domain;

(iii) a first VH domain, a CH1 domain, a TFc, a connecting linker, a second VH domain, an scFv linker and a second VL domain, wherein the second VH and VL domains associate to form a second binding site;

(iv) a first VH domain, a TFc, a connecting linker, a second VH domain, and a CH1 domain;

(v) a first VH domain, a first CH1 domain, a TFc, a connecting linker, a second VH domain and a second CH1 domain;

(vi) a first VH domain, a first scFv linker, a first VL domain, a TFc, a connecting linker, and a second VH domain, wherein the first VL and VH domains associate to form a first binding site;

(vii) a first VH domain, a first scFv linker, a first VL domain, a TFc, a connecting linker, a second VH domain, and a CH1 domain, wherein the first VL and VH domains associate to form a first binding site; and (viii) a first VH domain, a first scFv linker, a first VL domain, a TFc, a connecting linker, a second VH domain, a second scFv linker, and a second VL domain, wherein the first VH and VL domains form a first binding site and the second VH and VL domains form a second binding site.

A TFcBA of (i-)(v) may further comprise a light chain comprising a first VL domain and optionally a CL domain located at the C-terminus of the VL domain, wherein the first VH and VL domains associate to form a first binding site. A TFcBA of (i), (ii), (iv)-(vii) may comprise a light chain comprising a second VL domain and optionally a CL domain located at the C-terminus of the VL domain, wherein the first VH and VL domains associate to form a second binding site.

In certain embodiments, a heavy chain comprises a first VH domain, which is linked at its C-terminus to the N-terminus of a TFc, which is linked at its C-terminus to the N-terminus of a connecting linker, which is linked at its C-terminus to the N-terminus of a second VH domain. In certain embodiments, a heavy chain comprises a first VH domain, which is linked at its C-terminus to the N-terminus of a CH1 domain, which is linked at its C-terminus to the N-terminus of a TFc, which is linked at its C-terminus to the N-terminus of a connecting linker, which is linked at its C-terminus to the N-terminus of a second VH domain. In certain embodiments, a heavy chain comprises a first VH domain, which is linked at its C-terminus to the N-terminus of a CH1 domain, which is linked at its C-terminus to the N-terminus of a TFc, which is linked at its C-terminus to the N-terminus of a connecting linker, which is linked at its C-terminus to the N-terminus of a second VH domain, which is linked at its C-terminus to the N-terminus of an scFv linker, which is linked at its C-terminus to the N-terminus of a second VL domain, wherein the second VH and VL domains associate to form a second binding site. In certain embodiments, a heavy chain comprises a first VH domain, which is linked at its C-terminus to the N-terminus of a TFc, which is linked at its C-terminus to the N-terminus of a connecting linker, which is linked at its C-terminus to the N-terminus of a second VH domain, which is linked at its C-terminus to the N-terminus of a CH1 domain. In certain embodiments, a heavy chain comprises a first VH domain, which is linked at its C-terminus to the N-terminus of a first CH1 domain, which is linked at its C-terminus to the N-terminus of a TFc, which is linked at its C-terminus to the N-terminus of a connecting linker, which is linked at its C-terminus to the N-terminus of a second VH domain, which is linked at its C-terminus to the N-terminus of a second CH1 domain. In certain embodiments, a heavy chain comprises a first VH domain, which is linked at its C-terminus to the N-terminus of a first scFv linker, which is linked at its C-terminus to the N-terminus of a first VL domain, which is linked at its C-terminus to the N-terminus of a TFc, which is linked at its C-terminus to the N-terminus of a connecting linker, which is linked at its C-terminus to the N-terminus of a second VH domain, wherein the first VH and VL domains associate to form a first binding site. In certain embodiments, a heavy chain comprises a first VH domain, which is linked at its C-terminus to the N-terminus of a first scFv linker, which is linked at its C-terminus to the N-terminus of a first VL domain, which is linked at its C-terminus to the N-terminus of a TFc, which is linked at its C-terminus to the N-terminus of a connecting linker, which is linked at its C-terminus to the N-terminus of a second VH domain, which is linked at its C-terminus to the N-terminus of a CH1 domain, wherein the first VH and VL domains associate to form a first binding site. In certain embodiments, a heavy chain comprises a first VH domain, which is linked at its C-terminus to the N-terminus of a first scFv linker, which is linked at its C-terminus to the N-terminus of a first VL domain, which is linked at its C-terminus to the N-terminus of a TFc, which is linked at its C-terminus to the N-terminus of a connecting linker, which is linked at its C-terminus to the N-terminus of a second VH domain, which is linked at its C-terminus to the N-terminus of a second scFv linker, which is linked at its C-terminus to the N-terminus of a second VL domain, wherein the first VH and VL domains form a first binding site and the second VH and VL domains form a second binding site.

In certain embodiments, a VL domain is substituted for the VH domain and the VH domain is substituted for the VL domain in the constructs above.

When the heavy chain does not comprise either a first or a second VL domain, a VL domain may be provided by a light chain. A light chain may comprise a first or a second VL domain and optionally a CL domain. For example, an scFv may comprise in amino to carboxy terminal order a VL domain, an scFv linker and a VH domain.

In certain embodiments, a TFcBA comprises a first antigen binding site that binds specifically to a first receptor and a second antigen binding site that binds specifically to a second receptor. In certain embodiments, the first antigen binding site that binds specifically to the first receptor is a Fab and the second antigen binding site that binds specifically to the second receptor is an scFv. Exemplary combinations of binding sites are set forth in Table 3, wherein a "yes" indicates a possible combination and anti-c-Met+anti-EGFR TFcBAs are used to illustrate the possible combinations:

TABLE 3

Exemplary combinations of binding sites of anti-c-Met + anti-EGFR TFcBAs

| | | Binding site linked to the N-terminus of the TFc | | | |
|---|---|---|---|---|---|
| | | Anti-c-Met scFv | Anti-c-Met Fab | Anti-EGFR scFv | Anti-EGFR Fab |
| Binding site linked to the C-terminus of the TFc | Anti-c-Met scFv | yes | yes | yes | yes |
| | Anti-c-Met Fab | yes | yes | yes | yes |
| | Anti-EGFR scFv | yes | yes | yes | yes |
| | Anti-EGFR Fab | yes | yes | yes | yes |

In certain embodiments, a TFcBA comprises more than 2 binding sites. A TFcBA may comprise 3, 4, 5, 6 or more binding sites. Additional binding sites may be linked, e.g., to the N- and/or C-terminus of a TFcA or TFcBA. For example, a heavy chain may comprise one or more Fabs and/or scFvs linked to the amino- or carboxyl-terminus of the TFc.

Exemplary domains of TFcBAs are further described below.

Exemplary Hinges

In one embodiment, the first and/or the second Fc region of a TFcA, e.g., a TFcBA, comprises an IgG upper hinge, an IgG middle hinge and/or an IgG lower hinge. For example, an Fc region may comprise one or more IgG1 upper, middle and lower hinge, e.g., set forth in SEQ ID NOs:1, 2 and 3, respectively (see Table 2). Fc regions may also comprise one or more of an IgG2 upper, middle and lower hinge, e.g., set forth in SEQ ID NOs:5, 2 and 6, respectively (the middle hinge of IgG1 and IgG2 have the same aa sequence/see Table 2). Fc regions may also comprise one or more of an IgG3 upper, middle and lower hinge, e.g., set forth in SEQ ID NOs:8, 9 and 10, respectively (Table 2). Fc regions may also comprise one or more of an IgG4 upper, middle and lower hinge, e.g., set forth in SEQ ID NOs:12, 13 and 14, respectively (Table 2). Fc regions may also comprise one or more mouse Ig sequences or IgA1 or IgA2 sequences.

A first and/or a second Fc region of a TFcA may also comprise an aa sequence of an upper, middle, or lower hinge having an aa sequence that differs from a naturally occurring sequence, such as a sequence set forth herein (e.g., SEQ ID NOs:1-14) comprising up to 1, 2, 3, 4, or 5 aa modifications, e.g., aa substitutions, deletions or additions. For example, the following IgG1 upper hinges may be used:

EPKSCDKTCC (SEQ ID NO: 16; corresponds to SEQ ID NO: 1 with the aa substitutions H224C and T225C (underlined)) and EPKSCDKCHT (SEQ ID NO: 17; corresponds to SEQ ID NO: 1 with the aa substitution T223C (underlined)).

The amino acid numbering of the hinge residues referred to herein is according to their numbering in a full length antibody (EU numbering; see FIG. 2).

In one embodiment, the first and/or the second hinge of a TFcA is a full length wild type IgG1 hinge comprising the following aa sequence:

```
                                        (SEQ ID NO: 4)
                EPKSCDKTHTCPPCPAPELLG.
```

The first and/or the second hinge of a TFcBA may also consist of an IgG1 hinge comprising up to 1, 2, 3, 4, or 5 aa modifications, e.g., aa substitutions, deletions or additions, relative to SEQ ID NO:4. For example, the following IgG1 hinges may be used:

EPKSCDKTCCCPPCPAPELLG (SEQ ID NO: 18; corresponds to SEQ ID NO: 4 with the aa substitutions H224C and T225C); and EPKSCDKCHTCPPCPAPELLG (SEQ ID NO: 19; corresponds to SEQ ID NO: 4 with the aa substitution T223C).

In one embodiment, the first and/or the second hinge of a TFcA is a hybrid hinge, i.e., a hinge that comprises portions from different IgG subclasses. In one embodiment, a hinge comprises an upper hinge from IgG1 and a middle and lower hinge from IgG4, and may, e.g., consist of the following aa sequence:

EPKSCDKTHTcpscpapeflg (SEQ ID NO:20; upper case residues represents IgG1 sequences and lower case residues represent IgG4 sequences).

The first and/or the second hinge of a TFcBA may also be a hybrid hinge comprising the aa sequence set forth in SEQ ID NO:20, comprising up to 1, 2, 3, 4, or 5 aa modifications, e.g., aa substitutions, deletions or additions. For example, the following IgG1/IgG4 hybrid hinges may be used:

EPKSCDKTCCcpscpapeflg (SEQ ID NO:21; corresponds to SEQ ID NO:20 with the aa substitutions H224C and T225C; upper case residues represent IgG1 sequences and lower case residues represent IgG4 sequences); and EPKSCDKCHTcpscpapeflg (SEQ ID NO:22; corresponds to SEQ ID NO:20 with the aa substitution T223C).

In certain embodiments, the first and/or the second Fc region comprises a portion of a hinge instead of a full length hinge. For example, a first and/or a second Fc region of a TFcBA may comprise a hinge lacking the upper, middle and/or lower hinge. In certain embodiments, an Fc region comprises a middle and lower hinge, but does not comprise an upper hinge. An exemplary aa sequence of an IgG1 middle and lower hinge is the following:

```
                                        (SEQ ID NO: 23)
                CPPCPAPELLG.
```

An exemplary aa sequence of an IgG4 middle and lower hinge is the following:

```
(SEQ ID NO: 24)
CPSCPAPEFLG.
```

A summary of the aa numbers of the hinges and portions thereof provided above is set forth in Table 4. Alignments of the IgG1 and IgG1/IgG4 hybrid hinges are set forth in FIG. 2.

TABLE 4

SEQ ID NOs of exemplary hinges and subdomains thereof

| | IgG1 | IgG4 | IgG1/IG4 hybrid hinge |
|---|---|---|---|
| Upper hinge | SEQ ID NO: 1 | SEQ ID NO: 12 | SEQ ID NO: 1 |
| Upper hinge with H224C/T225C | SEQ ID NO: 16 | — | SEQ ID NO: 16 |
| Upper hinge with T223C | SEQ ID NO: 17 | — | SEQ ID NO: 17 |
| Middle hinge | SEQ ID NO: 2 | SEQ ID NO: 13 | SEQ ID NO: 13 |
| Lower hinge | SEQ ID NO: 3 | SEQ ID NO: 14 | SEQ ID NO: 14 |
| Middle and lower hinge | SEQ ID NO: 23 | SEQ ID NO: 24 | SEQ ID NO: 24 |
| Complete hinge | SEQ ID NO: 4 | SEQ ID NO: 15 | SEQ ID NO: 20 |
| Complete hinge with H224C/T225C | SEQ ID NO: 18 | — | SEQ ID NO: 21 |
| Complete hinge with T223C | SEQ ID NO: 19 | — | SEQ ID NO: 22 |

Cysteines may also be introduced at positions other than T223, H224 and T225 in a hinge, e.g., by the substitution K222C, described in WO2010/064090.

Additional hinges that may be used in TFcAs include hIgG1 hinge variants comprising one of the following aa sequences (FIG. 2):

```
(SEQ ID NO: 263; hIgG1 Extra Prolines v1)
PPPPCDKTHTCPPCP

(SEQ ID NO: 264; hIgG1 Extra Prolines v2)
EPKSCPPPCPPCP

(SEQ ID NO: 265; hIgG1-like double core)
EPKSCPPCPCPPCP
```

Hinges that may be used in TFcAs may also include mouse hinge sequences, e.g., mIgG1 and mIgG2 sequences, and hybrids thereof. An exemplary mIgG1/mIgG2A hinge comprises the aa sequence

```
(SEQ ID NO: 267)
VPRDCTIKPCPPCP.
```

Other hinges that may be used in TFcAs comprise an IgG2 hinge or variant thereof, such as a variant comprising one of the following amino acid sequences (FIG. 2):

```
(SEQ ID NO: 268; hIgG2 C232P)
ERKPCVECPPCP

(SEQ ID NO: 269; hIgG2 C233P)
ERKCPVECPPCP
```

In certain embodiments, a TFcA comprises an IgA, e.g., IgA2, hinge or variant thereof. Exemplary IgA2 hinge variants include those comprising one of the following aa sequences (FIG. 2):

```
(SEQ ID NO: 271; hIgA2 Modified v1)
EPKSCPCPPPPPCCP

(SEQ ID NO: 272; hIgA2 modified v2)
EPKSCPCPPPPCCP

(SEQ ID NO: 273; hIgA2 Modified v3)
EPKSCPVPPPPPCCP
```

Other variations, e.g., aa modifications, may also be introduced into a hinge. For example, the substitution S228P may be made in the middle hinge of IgG4 to stabilize the interaction between two Fc regions comprising IgG4 middle hinges.

A TFcA comprising IgG2 sequences in its Fab domain may comprise the mutation C129S in the heavy chain portion of the Fab domain, which is a mutation of the cysteine that normally links the heavy chain to the light chain. Such a mutation will encourage the formation of a disulfide bridge between the light chain cysteine and C232 in the heavy chain, and C233 will pair with C233 of the neighboring hinge (in addition to the two disulfides in the CPPCP motif (SEQ ID NO: 2)).

In certain embodiments, the following variant hinges are used:

```
(SEQ ID NO: 248)
PRDCGCKPCICT,

(SEQ ID NO: 249)
PKSCGCKPCICT,

(SEQ ID NO: 250)
PKSCGCKPCICP,

(SEQ ID NO: 251)
PRDCGCKPCPPCP,

(SEQ ID NO: 252)
PRDCGCHTCPPCP,

(SEQ ID NO: 253)
PKSCDCHCPPCP,
and

(SEQ ID NO: 254)
RKCCVECPPCP.
```

In certain embodiments, a TFcBA does not comprise a first or a second hinge. For example, instead of a first hinge, a TFcBA may comprise a connecting linker that links the first binding site to the first CH2 domain. Such a linker may be a Gly-Ser linker as further described herein in the context of TFc linkers. In certain embodiments, a connecting linker comprises a $(G_4S)$ 2 (SEQ ID NO: 494) or $(G_4S)_3$ (SEQ ID NO: 495) or $(G_4S)_4$ (SEQ ID NO: 496) sequence. Other peptide sequences may also be used as a connecting linker provided that they provide the required flexibility and rigidity of certain parts of the linker. In certain embodiments, a TFcBA does not comprise a second hinge, but comprises a connecting linker instead, which may be a Gly-Ser linker similar to that of the TFc linker.

Exemplary CH2 Domains

In certain embodiments, an Fc region comprises a CH2 domain. A CH2 domain may be from a human IgG1, IgG2, IgG3 or IgG4 or from a combination thereof (a "hybrid" CH2 domain). An exemplary full length wild type IgG1 CH2 domain consists of the following aa sequence:

(SEQ ID NO: 261)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAK.

An exemplary full length IgG1 CH2 domain with an N297Q substitution to reduce the glycosylation at that residue, such that the variant is substantially aglycosylated when expressed in a mammalian cell, consists of the following amino acid sequence:

(SEQ ID NO: 25)
GPSVFLFPPKPKDTLMISRTPEVTCVVVDVSHEDPEVKFNWYVDGVEVHN

AKTKPREEQYQSTYRVVSVLTVLHQDWLNGKEYKCKVSNKALPAPIEKTI

SKAK.

An exemplary full length wild type IgG4 CH2 domain comprises the following aa sequence:

(SEQ ID NO: 262)
GPSVFLFPPKPKDTLMISRTPEVTCVVVDVSQEDPEVQFNWYVDGVEVHN

AKTKPREEQFNSTYRVVSVLTVLHQDWLNGKEYKCKVSNKGLPSSIEKTI

SKAK.

An exemplary full length IgG4 CH2 domain with a T299K substitution to reduce the glycosylation at residue 297, such that the variant is substantially aglycosylated when expressed in a mammalian cell, consists of the following amino acid sequence:

(SEQ ID NO: 26)
GPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTI

SKAK.

A CH2 domain may also comprise an aa sequence that differs from that of IgG1, IgG2, IgG3 or IgG4 in one or more aa modifications, e.g., aa deletions, additions or substitutions. In certain embodiments, a CH2 domain comprises an aa sequence that differs from that of a naturally occurring (or wild type) CH2 domain (e.g., SEQ ID NO:261 and 262) or from SEQ ID NOs:25 or 26 in at most, 1, 2, 3, 4, 5, 6, 7, 8, 9, 10, 15, 20, 25 or 30 aas. In certain embodiments, a CH2 domain comprises an aa sequence that is at least 70%, 75%, 80%, 85%, 90%, 95%, 97%, 98% or 99% identical or similar to that of a naturally occurring CH2 domain (e.g., SEQ ID NO:261 and 262) or SEQ ID NOs:25 or 26. Exemplary modifications include other modifications to reduce or remove glycosylation at aa 297. A modification may generally comprise an amino acid substitution in any of EU positions 297-299 (aa motif NXT) such that the variant is substantially aglycosylated when expressed in a mammalian cell. In addition to T299K, other substitutions that may be made at aa 299 to reduce glycosylation at aa 297 include T299S, T299A, T299N, T299G, T299Y, T299C, T299H, T299E, T299D, T299R, T299G, T299I, T299L, T299M, T299F, T299P, T299W, and T299V, as described, e.g., in WO/2005/018572.

Other aa changes may affect antibody effector functions, e.g., ADCC and CDC, or stability or other desired antibody characteristic. For example, FcγRI binding to an IgG1 Fc region may be modulated by modifying Leu235 and/or Gly237. Binding to C1q for CDC may be modulated by substitution of Ala330 and/or Pro331. Other modifications that may be made to CH2 domains to modulate the effector functions include substitutions at one or more aas at positions 234 to 238, 253, 279, 310, 318, 320, and 322.

Exemplary CH3 Domains

In certain embodiments, the first and/or the second Fc region of a TFcA, e.g., a TFcBA, comprises a CH3 domain. A CH3 domain may be from a human immunoglobulin, e.g., an IgG1, IgG2, IgG3 or IgG4, or from a combination thereof (a "hybrid" CH3 domain). An exemplary full length wild type IgG1 CH3 domain comprises the following aa sequence:

(SEQ ID NO: 27)
GQPREPQVYTLPPSRDELTKNQVSLTCLVKGFYPSDIAVEWESNGQPENN

YKTTPPVLDSDGSFFLYSKLTVDKSRWQQGNVFSCSVMHEALHNHYTQKS

LSLSPGK.

In certain embodiments, variations of SEQ ID NO:27 may be used. For example, the C-terminal lysine of the CH3 domain may be deleted (see SEQ ID NO:28 in FIG. 3). In other embodiments, a CH3 domain comprises the aa substitutions D356E and L358M and the C-terminal lysine may be present or absent (SEQ ID Nos:29 and 30 respectively, and shown in FIG. 3).

In certain embodiments, the first and/or the second CH3 domains of a TFcA are modified to enhance the association of the first and the second Fc comprising the first and the second CH3 domains, respectively. Such CH3 modifications are referred to herein as Association Enhancing Modifications ("AEMs"). As further described in the Examples, it has been unexpectedly found that the addition of a TFc linker joining the two Fc regions of an Ab further enhances the ability of Abs having AEMs to properly assemble and increases their stability.

Exemplary AEM modifications that can be used are modifications that create "knobs-into-holes" and which are described, e.g., in U.S. Pat. No. 7,183,076. In this strategy, the CH3 domains are engineered to give one a protruding "knob" or "bump" and the other a complementary "hole," thereby favoring the association of the CH3 domains. An exemplary aa modification to a CH3 domain that creates a "hole" is the combination of aa substitutions T366S, L368A and Y407V (e.g., in SEQ ID NOs:31-34; FIG. 3). Such a CH3 domain with a "hole" will dimerize favorably with a CH3 domain having a "knob" or "bump," e.g., a CH3 domain comprising the amino acid substitution T366W (e.g., in SEQ ID NOs:35-38; FIG. 3). This pair of knob/hole mutations is referred to herein as "AEM module 1" or "AEM 1," of which the first and the second CH3 domains are referred to as "AEM 1.1" and "AEM 1.2," respectively.

In another embodiment, one of the two CH3 domains of a TFcA comprises a hole created by the substitution Y407T (e.g., in SEQ ID NOs:39-42; FIG. 3) and the other CH3 domain comprises a knob created by the substitution T366Y (e.g., in SEQ ID NOs:43-46; FIG. 3). This second pair of knob/hole mutations is referred to as "AEM module 2" or "AEM 2," of which the first and the second CH3 domains are referred to as "AEM 2.1" and "AEM 2.2," respectively.

The association between two CH3 domains may also be enhanced by mechanisms other than those creating typical knob/holes, e.g., by electrostatic modifications. In one embodiment, one of the two CH3 domains of a TFcA comprises the combination of substitutions S364H and F405A (e.g., in SEQ ID NOs:47-50; FIG. 3) and the other CH3 domain comprises the combination of substitutions Y349T and T394F (e.g., in SEQ ID NOs:51-54; FIG. 3). This third pair of modifications is referred to herein as "AEM module 3" or "AEM 3," of which the first and the second CH3 domains are referred to as "AEM 3.1" and "AEM 3.2," respectively.

In one embodiment, one of the two CH3 domains of a TFcA comprises the combination of substitutions K370D, K392D and K409D (e.g., in SEQ ID NOs:55-58; FIG. 3) and the other CH3 domain comprises the combination of substitutions E (or D)356K, E357K and D399K (e.g., in SEQ ID NOs:59-62; FIG. 3). This fourth pair of modifications is referred to herein as "AEM module 4" or "AEM 4," of which the first and the second CH3 domains are referred to as "AEM 4.1" and "AEM 4.2," respectively. The aa at position 356 may be either an E or a D, depending on the sequence that is used, and therefore the substitution at that position is referred to as "E (or D)356."

In certain embodiments, the first and/or the second CH3 domains of a TFcA comprise one or more aa modifications resulting in the addition of one or more Cysteines that allow the formation of one or more disulfide bonds between the two CH3 or Fc domains. In one embodiment, one of the two CH3 domains of a TFcA comprises the substitution Y349C (e.g., in SEQ ID NOs:63-66; FIG. 3) and the other CH3 domain comprises the substitution S354C (e.g., in SEQ ID NOs:67-70; FIG. 3). This pair of disulfide forming modifications is referred to herein as "DiS module 1" or "DiS 1," of which the first and the second CH3 domains are referred to as "DiS 1.1" and "DiS 1.2," respectively.

In other embodiments, a cysteine is added to the C-terminus of each of the two CH3 domains of a TFcA, to thereby form a disulfide bond between the two CH3 domains. For example, one of the two CH3 domains may comprise the substitution of the carboxyl terminal aas "PGK" with "KSCDKT" (SEQ ID NO: 167) (e.g., in SEQ ID NOs:71-72; FIG. 3) and the other CH3 domain may comprise the substitution of the carboxyl-terminal aas "PGK" with "GEC" (SEQ ID NO: 168) (e.g., in SEQ ID NOs:73-74; FIG. 3).

In certain embodiments, a CH3 domain comprises a combination of two or more aa change(s). For example, one or more AEMs may be combined with one or more DiS modifications. In an exemplary embodiment, a CH3 domain comprises the hole mutations T366S, L368A, Y407V and the disulfide bond generating mutation Y349C (AEM 1.1+DiS 1.1). Such a CH3 domain may be combined in a TFc with a CH3 domain comprising the knob mutation T366W and the disulfide bond generating mutation S354C (AEM 1.2+DiS 1.2). Exemplary aa sequences comprising this combination of substitutions include SEQ ID NOs:75-82 (FIG. 3).

Exemplary combinations of AEMs and DiSs that are made in CH3 domains to favor the association of CH3 domains or Fc regions comprising these are set forth in Table 5, wherein a "yes" indicates a combination that may be used.

TABLE 5

Exemplary combinations of AEM and DiS modifications ("KSCDKT" and "GEC" disclosed as SEQ ID NOS 167 and 168, respectively)

| | | AEM module 1 | | AEM module 2 | | AEM module 3 | | AEM module 4 | |
|---|---|---|---|---|---|---|---|---|---|
| | | 1.1 T366S/ L368A/ Y470V | 1.2 T366W | 2.1 Y407T | 2.2 T366Y | 3.1 S364H/ F405A | 3.2 Y349T/ T394F | 4.1 K370D/ K392D/ K409D | 4.2 D356K*/ E357K/ D399K |
| DiS 1 | 1.1 Y349C | yes | yes | yes | yes | yes | yes | yes | yes |
| | 1.2 S354C | yes | yes | yes | yes | yes | yes | yes | yes |
| DiS 2 | 2.1 C. term. KSCDKT | yes | yes | yes | yes | yes | yes | yes | yes |
| | 2.2 C term. GEC | yes | yes | yes | yes | yes | yes | yes | yes |

*With respect to the sequences that have an E at position 356 (e.g., SEQ ID NOs: 29 and 30), this mutation is E356K.

Aa sequences of exemplary IgG1 CH3 domains with an AEM and/or DiS comprise SEQ ID NOs:31-98. An alignment of these aa sequences is provided in FIG. 3, and a description of these sequences is provided in Table 6. The CH3 domains in Table 6 and FIG. 3 are organized according to their AEM module (number 1, 2, 3 or 4) and their DiS module (number 1 or 2). Compatible CH3 domains are listed as "1" and "2" preceded by the module number.

TABLE 6

SEQ ID NOs for IgG1 CH3 domains with an AEM and/or a DiS ("KSCDKT" and "GEC" disclosed as SEQ ID NOS 167 and 168, respectively)

| | | Wild type | Wild type without terminal lysine | Wild type with D356E and L358M | Wild type with D356E and L358M; without a terminal lysine |
|---|---|---|---|---|---|
| | | SEQ ID NO: 27 | SEQ ID NO: 28 | SEQ ID NO: 29 | SEQ ID NO: 30 |
| AEM 1 | AEM 1.1 T366S/L368A/ Y407V | SEQ ID NO: 31 | SEQ ID NO: 32 | SEQ ID NO: 33 | SEQ ID NO: 34 |
| | AEM 1.2 T366W | SEQ ID NO: 35 | SEQ ID NO: 36 | SEQ ID NO: 37 | SEQ ID NO: 38 |

TABLE 6-continued

SEQ ID NOs for IgG1 CH3 domains with an AEM and/or a DiS ("KSCDKT" and "GEC" disclosed as SEQ ID NOS 167 and 168, respectively)

| | | Wild type | Wild type without terminal lysine | Wild type with D356E and L358M | Wild type with D356E and L358M; without a terminal lysine |
|---|---|---|---|---|---|
| AEM 2 | AEM 2.1 Y407T | SEQ ID NO: 39 | SEQ ID NO: 40 | SEQ ID NO: 41 | SEQ ID NO: 42 |
| | AEM 2.2 T366Y | SEQ ID NO: 43 | SEQ ID NO: 44 | SEQ ID NO: 45 | SEQ ID NO: 46 |
| AEM 3 | AEM 3.1 S364H/F405A | SEQ ID NO: 47 | SEQ ID NO: 48 | SEQ ID NO: 49 | SEQ ID NO: 50 |
| | AEM 3.2 Y349T/T394F | SEQ ID NO: 51 | SEQ ID NO: 52 | SEQ ID NO: 53 | SEQ ID NO: 54 |
| AEM 4 | AEM 4.1 K370D/K392D/K409D | SEQ ID NO: 55 | SEQ ID NO: 56 | SEQ ID NO: 57 | SEQ ID NO: 58 |
| | AEM 4.2 D356K*/E357K/D399K | SEQ ID NO: 59 | SEQ ID NO: 60 | SEQ ID NO: 61 | SEQ ID NO: 62 |
| DiS 1 | DiS 1.1 Y349C | SEQ ID NO: 63 | SEQ ID NO: 64 | SEQ ID NO: 65 | SEQ ID NO: 66 |
| | DiS 1.2 S354C | SEQ ID NO: 67 | SEQ ID NO: 68 | SEQ ID NO: 69 | SEQ ID NO: 70 |
| DiS 2 | DiS 2.1 C. term. KSCDKT | SEQ ID NO: 71 | — | SEQ ID NO: 72 | — |
| | DiS 2.2 C. term. GEC | SEQ ID NO: 73 | — | SEQ ID NO: 74 | — |
| AEM 1 + DiS 1 | AEM 1.1 + DiS 1.1 Y349C/T366S/L368A/Y407V | SEQ ID NO: 75 | SEQ ID NO: 76 | SEQ ID NO: 77 | SEQ ID NO: 78 |
| | AEM 1.2 + DiS 1.2 S354C/T366W | SEQ ID NO: 79 | SEQ ID NO: 80 | SEQ ID NO: 81 | SEQ ID NO: 82 |
| AEM 1 + DiS 2 | AEM 1.1 + DiS 2.1 T366S/L368A/Y407V/C. term. KSCDKT | SEQ ID NO: 83 | — | SEQ ID NO: 84 | — |
| | AEM 1.2 + DiS 2.2 T366W/C term. GEC | SEQ ID NO: 85 | — | SEQ ID NO: 86 | — |
| AEM 1 + DiS 2Inv | AEM 1.1 + DiS 2.2 T366S/L368A/Y407V/C term. GEC | SEQ ID NO: 87 | — | SEQ ID NO: 88 | — |
| | AEM 2.1 + DiS 2.1 T366W/C. term. KSCDKT | SEQ ID NO: 89 | — | SEQ ID NO: 90 | — |
| AEM 3 + DiS 2 | AEM 3.1 + DiS 2.1 S364H/F405A/C term. KSCDKT | SEQ ID NO: 91 | — | SEQ ID NO: 92 | — |
| | AEM 3.2 + DiS 2.2 Y349T/T394F/C term. GEC | SEQ ID NO: 93 | — | SEQ ID NO: 94 | — |
| AEM 4 + DiS 2 | AEM 4.1 + DiS 2.1 K370D/K392D/K409D/C. term. KSCDKT | SEQ ID NO: 95 | — | SEQ ID NO: 96 | — |
| | AEM 4.2 + DiS 2.2 D356K*/E357K/D399K/C term. GEC | SEQ ID NO: 97 | — | SEQ ID NO: 98 | — |

*With respect to the sequences that have an E at position 356 (e.g., SEQ ID NOs: 29 and 30), this mutation is E356K.

Other CH3 AEMs that may be used in TFcAs include the following pairs of aa modifications, wherein the substitution(s) to the first and the second member of a pair of AEM modifications are separated by "and":

1) F405A and T394F; S364D and Y349K; S364E and L368K; S364E Y349K; S364F and K370G; S364H and Y349K; S364H and Y349T; S364Y and K370G; T411K and K370E; V397S/F405A and T394F; K370R/T411K and K370E/T411E; L351E/S364D and Y349K/L351K; L351E/S364E and Y349K/L351K; L351E/T366D and L351K/T366K; P395T/V397S/F405A and T394F; S364D/K370G and S364Y/K370R S364D/T394F and Y349K/F405A; S364E/F405A and Y349K/T394F; S364E/F405S and Y349K/T394Y; S364E/T411E and Y349K/D401K; S364H/D401K and Y349T/T411E; S364H/T394F and Y349T/F405A; Y349C/S364E and Y349K/S354C; L351E/S364D/F405A and Y349K/L351K/T394F; L351K/S364H/D401K and Y349T/L351E/T411E; S364E/T411E/F405A and Y349K/F394F/D401K; S364H/D401K/F405A and Y349T/T394F/T411E; S364H/F405A/T411E and Y349T/T394F/D401K (WO2011/028952).
2) T366W and Y407A; T366W and T366S; L368A and Y407Y; K409E and D399K; K409E, and D399R; and K409D and D399K; K409D and D399R; K392E and D399R; K392E and D399K; K392D and D399R; and K392D and D399R (WO2009/089004).
3) T366W and Y407A; F405A and T394W; Y407T and T366Y/F366Y/F405A and T394W/Y407T; T366W/F405W and T394S/Y407A; F405W/Y407A and T366W/T394S; and F405W and T394S (U.S. Pat. No. 7,642,228).

Generally, any other AEM or DiS described in the art may be used.

A CH3 domain may also comprise an aa sequence that differs from that of a CH3 aa sequence provided herein, e.g., SEQ ID NOs:27-98, in at most, 1, 2, 3, 4, 5, 6, 7, 8, 9, 10, 15, 20, 25 or 30 aas. In certain embodiments, a CH3 domain comprises an aa sequence that is at least 70%, 75%, 80%, 85%, 90%, 95%, 97%, 98% or 99% identical to a CH3 aa sequence provided herein, e.g., SEQ ID NOs:27-98. As several antibody effector functions, e.g., ADCC and CDC are mediated at least in part through areas in CH3 domains, aa changes that can be made to CH3 domains include changes affecting the effector function(s) of Fc regions. Exemplary modifications that may be made to CH3 domains are further described herein.

Exemplary Fc Regions

An Fc region of a TFcA comprises one or more of a hinge, CH2 domain, CH3 domain and CH4 domain, which may be full length or not and which may be wild type or with aa modifications. The Fc domains may be from human immunoglobulins ("Igs") or non-human Igs, e.g., mouse Igs, and may be from any type or isotype of an Ig, such as an IgG (e.g., IgG1, IgG2, IgG3 and IgG4) or IgA (e.g., IgA1 and IgA2).

In certain embodiments, a TFcA comprises a TFc that comprises a first and/or a second Fc region from a human immunoglobulin, e.g., IgG1. An Fc region preferably comprises in a contiguous amino to carboxyl terminal order: an IgG1 hinge or portion thereof (e.g., a core and lower hinge), an IgG1 CH2 domain and an IgG1 CH3 domain. Fc regions may comprise any combination of an IgG1 hinge (or portion thereof), IgG1 CH2 domain and IgG1 CH3 domains set forth herein, provided that the TFcA has the desired activity and stability.

In certain embodiments, a TFc comprises a first and/or a second Fc region that is a hybrid Fc region. A hybrid Fc region may comprise Fc domains from two or more IgG subclasses IgG1, IgG2, IgG3 and IgG4. In one embodiment, a hybrid Fc region comprises in a contiguous amino to carboxyl terminal order: an IgG1 upper hinge, an IgG4 middle and lower hinge, an IgG4 CH2 domain and an IgG1 CH3 domain. Exemplary IgG1/IgG4 hybrid Fc regions may comprise any combination of an IgG1 upper hinge, IgG4 core hinge, IgG4 lower hinge, IgG 4 CH2 domain and IgG1 CH3 domains set forth herein, provided that the TFcA comprising the TFc has the desired activity and stability.

In certain embodiments, an Fc region does not comprise a full length hinge. For example, a TFcBA may comprise a first Fc region comprising a full length hinge and a second Fc region comprising a hinge that consists of the core and/or lower hinge and does not comprise an upper hinge.

In certain embodiments, a TFc comprises a hinge that has been modified to comprise a cysteine for forming a disulfide bond with another cysteine in the other Fc region, to thereby stabilize the TFc. In one embodiment, an IgG1 hinge comprises the substitutions H224C and T225C (e.g., SEQ ID NO:18; FIG. 2). In another embodiment, a hinge comprises the substitution T223C (e.g., SEQ ID NO: 19; FIG. 2).

In one embodiment, a TFcA comprises an IgG1 TFc comprising in amino to carboxyl terminal order: i) an IgG1 hinge selected from the group of hinges consisting of the aa sequences set forth in SEQ ID NO:4 (full length IgG1 hinge), SEQ ID NO:18 (SEQ ID NO:4 with H224C/T225C), SEQ ID NO:19 (SEQ ID NO:4 with T223C) and SEQ ID NO:23 (middle and lower IgG1 hinge only); ii) an IgG1 CH2 domain comprising SEQ ID NO:261 or 25; and iii) a CH3 domain comprising an aa sequence selected from the group of CH3 domains consisting of an aa sequence set forth in SEQ ID NOs:31-98 (FIG. 3). In another embodiment, a TFcA comprises an IgG1/IgG4 hybrid TFc comprising in amino to carboxyl terminal order: i) a hinge selected from the group of hinges consisting of an aa sequence set forth in SEQ ID NO:20 (IgG1 upper hinge and IgG4 core and lower hinge), SEQ ID NO:21 (SEQ ID NO:20 with H224C/T225C), SEQ ID NO:22 (SEQ ID NO:20 with T223C) and SEQ ID NO:24 (middle and lower IgG4 hinge only); ii) an IgG4 CH2 domain comprising SEQ ID NO:262 or 26; and iii) a CH3 domain comprising an aa sequence selected from the group of CH3 domains consisting of the aa sequences SEQ ID NOs:31-98 (FIG. 3). Exemplary combinations of hinges and CH3 domains are set forth in Table 7, wherein a "yes' indicates a combination that may be used, and wherein compatible modifications are separated from others by a blank row.

TABLE 7

Exemplary combinations of hinges and CH3 domains for forming Fc regions

| | | Hinge | | | | | | | |
|---|---|---|---|---|---|---|---|---|---|
| | | IgG1 SEQ ID NO: 1 | IgG1 H224C/ T225C SEQ ID NO: 18 | IgG1 T223C SEQ ID NO: 19 | Partial IgG1 SEQ ID NO: 23 | Hybrid SEQ ID NO: 20 | Hybrid H224C/ T225C SEQ ID NO: 21 | Hybrid T223C SEQ ID NO: 22 | Partial IgG4 SEQ ID NO: 24 |
| CH3 | AEM 1.1 SEQ ID NOs: 31-34 | yes | yes | yes | yes | yes | yes | yes | yes |
| | AEM 1.2 SEQ ID NOs: 35-38 | yes | yes | yes | yes | yes | yes | yes | yes |
| | AEM 2.1 SEQ ID NOs: 39-42 | yes | yes | yes | yes | yes | yes | yes | yes |
| | AEM 2.2 SEQ ID NOs: 43-46 | yes | yes | yes | yes | yes | yes | yes | yes |
| | AEM 3.1 SEQ ID NOs: 47-50 | yes | yes | yes | yes | yes | yes | yes | yes |
| | AEM 3.2 SEQ ID NOs: 51-54 | yes | yes | yes | yes | yes | yes | yes | yes |

TABLE 7-continued

Exemplary combinations of hinges and CH3 domains for forming Fc regions

| | Hinge | | | | | | | |
|---|---|---|---|---|---|---|---|---|
| | IgG1 SEQ ID NO: 1 | IgG1 H224C/ T225C SEQ ID NO: 18 | IgG1 T223C SEQ ID NO: 19 | Partial IgG1 SEQ ID NO: 23 | Hybrid SEQ ID NO: 20 | Hybrid H224C/ T225C SEQ ID NO: 21 | Hybrid T223C SEQ ID NO: 22 | Partial IgG4 SEQ ID NO: 24 |
| AEM 4.1 SEQ ID NOs: 55-58 | yes | yes | yes | yes | yes | yes | yes | yes |
| AEM 4.2 SEQ ID NOs: 59-62 | yes | yes | yes | yes | yes | yes | yes | yes |
| DiS 1.1 SEQ ID NOs: 63-66 | yes | yes | yes | yes | yes | yes | yes | yes |
| DiS 1.2 SEQ ID NOs: 67-70 | yes | yes | yes | yes | yes | yes | yes | yes |
| DiS 2.1 SEQ ID NOs: 71-72 | yes | yes | yes | yes | yes | yes | yes | yes |
| DiS 2.2 SEQ ID NOs: 73-74 | yes | yes | yes | yes | yes | yes | yes | yes |
| AEM 1.1 DiS 1.1 SEQ ID NOs: 75-78 | yes | yes | yes | yes | yes | yes | yes | yes |
| AEM 1.2 DiS 1.2 SEQ ID NOs: 79-82 | yes | yes | yes | yes | yes | yes | yes | yes |
| AEM 1.1 DiS 2.1 SEQ ID NOs: 83-84 | yes | yes | yes | yes | yes | yes | yes | yes |
| AEM 1.2 DiS 2.2 SEQ ID NOs: 85-86 | yes | yes | yes | yes | yes | yes | yes | yes |
| AEM 1.1 DiS 2.2 SEQ ID NOs: 87-88 | yes | yes | yes | yes | yes | yes | yes | yes |
| AEM 1.2 DiS 2.1 SEQ ID NOs: 89-90 | yes | yes | yes | yes | yes | yes | yes | yes |
| AEM 3.1 DiS 2.1 SEQ ID NOs: 91-92 | yes | yes | yes | yes | yes | yes | yes | yes |
| AEM 3.2 DiS 2.2 SEQ ID NOs: 93-94 | yes | yes | yes | yes | yes | yes | yes | yes |
| AEM 4.1 DiS 2.1 SEQ ID NOs: 95-96 | yes | yes | yes | yes | yes | yes | yes | yes |
| AEM 4.2 DiS 2.2 SEQ ID NOs: 97-98 | yes | yes | yes | yes | yes | yes | yes | yes |

In one embodiment, a TFcA comprises a TFc that comprises an IgG1 Fc region comprising a hinge comprising SEQ ID NO:4, a CH2 domain comprising SEQ ID NO:25 and a CH3 domain comprising SEQ ID NO:29, and may form, e.g., an IgG1 Fc region comprising SEQ ID NO:99 (see Table 8 and FIG. 4). Other combinations of IgG1 hinges, IgG1 CH2 domain, and IgG1 CH3 domains and exemplary IgG1 Fcs created by such combinations are provided in Table 8. The aa sequences of the exemplary IgG1 Fcs listed in Table 8 (SEQ ID NOs:99-132) are provided in FIG. 4. Compatible IgG1 Fcs in Table 8 are separated from other IgG1 Fcs by a blank row.

TABLE 8

SEQ ID NOs of exemplary combinations of IgG1 hinges, CH2 domain and CH3 domain forming exemplary IgG1 Fcs

| IgG1 Hinge | IgG1 CH2 | IgG1 CH3 | IgG1 Fc |
|---|---|---|---|
| SEQ ID NO: 4 | SEQ ID NO: 25 | SEQ ID NO: 29 | SEQ ID NO: 99 |
| SEQ ID NO: 23 | SEQ ID NO: 25 | SEQ ID NO: 29 | SEQ ID NO: 100 |
| SEQ ID NO: 4 | SEQ ID NO: 25 | SEQ ID NO: 33 | SEQ ID NO: 101 |
| SEQ ID NO: 23 | SEQ ID NO: 25 | SEQ ID NO: 37 | SEQ ID NO: 102 |
| SEQ ID NO: 4 | SEQ ID NO: 25 | SEQ ID NO: 37 | SEQ ID NO: 103 |
| SEQ ID NO: 23 | SEQ ID NO: 25 | SEQ ID NO: 33 | SEQ ID NO: 104 |
| SEQ ID NO: 4 | SEQ ID NO: 25 | SEQ ID NO: 77 | SEQ ID NO: 105 |
| SEQ ID NO: 23 | SEQ ID NO: 25 | SEQ ID NO: 81 | SEQ ID NO: 106 |
| SEQ ID NO: 4 | SEQ ID NO: 25 | SEQ ID NO: 81 | SEQ ID NO: 107 |
| SEQ ID NO: 23 | SEQ ID NO: 25 | SEQ ID NO: 77 | SEQ ID NO: 108 |
| SEQ ID NO: 4 | SEQ ID NO: 25 | SEQ ID NO: 41 | SEQ ID NO: 109 |
| SEQ ID NO: 23 | SEQ ID NO: 25 | SEQ ID NO: 45 | SEQ ID NO 110 |
| SEQ ID NO: 4 | SEQ ID NO: 25 | SEQ ID NO: 45 | SEQ ID NO: 111 |
| SEQ ID NO: 23 | SEQ ID NO: 25 | SEQ ID NO: 41 | SEQ ID NO: 112 |
| SEQ ID NO: 18 | SEQ ID NO: 25 | SEQ ID NO: 33 | SEQ ID NO: 113 |
| SEQ ID NO: 4 | SEQ ID NO: 25 | SEQ ID NO: 77 | SEQ ID NO: 114 |
| SEQ ID NO: 19 | SEQ ID NO: 25 | SEQ ID NO: 33 | SEQ ID NO: 115 |
| SEQ ID NO: 4 | SEQ ID NO: 25 | SEQ ID NO: 77 | SEQ ID NO: 116 |
| SEQ ID NO: 4 | SEQ ID NO: 25 | SEQ ID NO: 84 | SEQ ID NO: 117 |
| SEQ ID NO: 23 | SEQ ID NO: 25 | SEQ ID NO: 86 | SEQ ID NO: 118 |
| SEQ ID NO: 4 | SEQ ID NO: 25 | SEQ ID NO: 86 | SEQ ID NO: 119 |
| SEQ ID NO: 23 | SEQ ID NO: 25 | SEQ ID NO: 84 | SEQ ID NO: 120 |
| SEQ ID NO: 4 | SEQ ID NO: 25 | SEQ ID NO: 88 | SEQ ID NO: 121 |
| SEQ ID NO: 23 | SEQ ID NO: 25 | SEQ ID NO: 90 | SEQ ID NO: 122 |
| SEQ ID NO: 4 | SEQ ID NO: 25 | SEQ ID NO: 90 | SEQ ID NO: 123 |
| SEQ ID NO: 23 | SEQ ID NO: 25 | SEQ ID NO: 88 | SEQ ID NO: 124 |
| SEQ ID NO: 4 | SEQ ID NO: 25 | SEQ ID NO: 92 | SEQ ID NO: 125 |
| SEQ ID NO: 23 | SEQ ID NO: 25 | SEQ ID NO: 94 | SEQ ID NO: 126 |
| SEQ ID NO: 4 | SEQ ID NO: 25 | SEQ ID NO: 94 | SEQ ID NO: 127 |

TABLE 8-continued

SEQ ID NOs of exemplary combinations of IgG1 hinges, CH2 domain and CH3 domain forming exemplary IgG1 Fcs

| IgG1 Hinge | IgG1 CH2 | IgG1 CH3 | IgG1 Fc |
|---|---|---|---|
| SEQ ID NO: 23 | SEQ ID NO: 25 | SEQ ID NO: 92 | SEQ ID NO: 128 |
| SEQ ID NO: 4 | SEQ ID NO: 25 | SEQ ID NO: 96 | SEQ ID NO: 129 |
| SEQ ID NO: 23 | SEQ ID NO: 25 | SEQ ID NO: 98 | SEQ ID NO: 130 |
| SEQ ID NO: 4 | SEQ ID NO: 25 | SEQ ID NO: 98 | SEQ ID NO: 131 |
| SEQ ID NO: 23 | SEQ ID NO: 25 | SEQ ID NO: 96 | SEQ ID NO: 132 |

In one embodiment, a TFcA comprises a TFc that comprises an IgG1/IgG4 Fc region comprising a hinge comprising SEQ ID NO:20, a CH2 domain comprising SEQ ID NO:26 and a CH3 domain comprising SEQ ID NO:29, and may form, e.g., an IgG1/IgG4 hybrid Fc region comprising SEQ ID NO:133 (see Table 9 and FIG. 4). Other combinations of IgG1/IgG4 hinges, IgG4 CH2 domain, and IgG1 CH3 domains and exemplary IgG1/IgG4 hybrid Fcs created by such combinations are provided in Table 9. The aa sequences of the exemplary IgG1/IgG4 hybrid Fcs listed in Table 9 (SEQ ID NOs:133-166) are provided in FIG. 5. Compatible IgG1 Fcs in Table 9 are separated from other IgG1 Fcs by a blank row.

TABLE 9

Exemplary combinations of IgG1/IgG4 hinges, CH2 domain and CH3 domain forming exemplary IgG1/IgG4 hybrid Fcs

| Hinge | IgG4 CH2 | IgG1 CH3 | IgG1/IgG4 Fc |
|---|---|---|---|
| SEQ ID NO: 20 | SEQ ID NO: 26 | SEQ ID NO: 29 | SEQ ID NO: 133 |
| SEQ ID NO: 24 | SEQ ID NO: 26 | SEQ ID NO: 29 | SEQ ID NO: 134 |
| SEQ ID NO: 20 | SEQ ID NO: 26 | SEQ ID NO: 33 | SEQ ID NO: 135 |
| SEQ ID NO: 24 | SEQ ID NO: 26 | SEQ ID NO: 37 | SEQ ID NO: 136 |
| SEQ ID NO: 20 | SEQ ID NO: 26 | SEQ ID NO: 37 | SEQ ID NO: 137 |
| SEQ ID NO: 24 | SEQ ID NO: 26 | SEQ ID NO: 33 | SEQ ID NO: 138 |
| SEQ ID NO: 20 | SEQ ID NO: 26 | SEQ ID NO: 77 | SEQ ID NO: 139 |
| SEQ ID NO: 24 | SEQ ID NO: 26 | SEQ ID NO: 81 | SEQ ID NO: 140 |
| SEQ ID NO: 20 | SEQ ID NO: 26 | SEQ ID NO: 81 | SEQ ID NO: 141 |
| SEQ ID NO: 24 | SEQ ID NO: 26 | SEQ ID NO: 77 | SEQ ID NO: 142 |
| SEQ ID NO: 20 | SEQ ID NO: 26 | SEQ ID NO: 41 | SEQ ID NO: 143 |
| SEQ ID NO: 24 | SEQ ID NO: 26 | SEQ ID NO: 45 | SEQ ID NO: 144 |
| SEQ ID NO: 20 | SEQ ID NO: 26 | SEQ ID NO: 45 | SEQ ID NO: 145 |
| SEQ ID NO: 24 | SEQ ID NO: 26 | SEQ ID NO: 41 | SEQ ID NO: 146 |
| SEQ ID NO: 21 | SEQ ID NO: 26 | SEQ ID NO: 33 | SEQ ID NO: 147 |
| SEQ ID NO: 24 | SEQ ID NO: 26 | SEQ ID NO: 77 | SEQ ID NO: 148 |
| SEQ ID NO: 22 | SEQ ID NO: 26 | SEQ ID NO: 33 | SEQ ID NO: 149 |
| SEQ ID NO: 24 | SEQ ID NO: 26 | SEQ ID NO: 77 | SEQ ID NO: 150 |
| SEQ ID NO: 20 | SEQ ID NO: 26 | SEQ ID NO: 84 | SEQ ID NO: 151 |

TABLE 9-continued

Exemplary combinations of IgG1/IgG4 hinges, CH2 domain and CH3 domain forming exemplary IgG1/IgG4 hybrid Fcs

| Hinge | IgG4 CH2 | IgG1 CH3 | IgG1/IgG4 Fc |
|---|---|---|---|
| SEQ ID NO: 24 | SEQ ID NO: 26 | SEQ ID NO: 86 | SEQ ID NO: 152 |
| SEQ ID NO: 20 | SEQ ID NO: 26 | SEQ ID NO: 86 | SEQ ID NO: 153 |
| SEQ ID NO: 24 | SEQ ID NO: 26 | SEQ ID NO: 84 | SEQ ID NO: 154 |
| SEQ ID NO: 20 | SEQ ID NO: 26 | SEQ ID NO: 88 | SEQ ID NO: 155 |
| SEQ ID NO: 24 | SEQ ID NO: 26 | SEQ ID NO: 90 | SEQ ID NO: 156 |
| SEQ ID NO: 20 | SEQ ID NO: 26 | SEQ ID NO: 90 | SEQ ID NO: 157 |
| SEQ ID NO: 24 | SEQ ID NO: 26 | SEQ ID NO: 88 | SEQ ID NO: 158 |
| SEQ ID NO: 20 | SEQ ID NO: 26 | SEQ ID NO: 92 | SEQ ID NO: 159 |
| SEQ ID NO: 24 | SEQ ID NO: 26 | SEQ ID NO: 94 | SEQ ID NO: 160 |
| SEQ ID NO: 20 | SEQ ID NO: 26 | SEQ ID NO: 94 | SEQ ID NO: 161 |
| SEQ ID NO: 24 | SEQ ID NO: 26 | SEQ ID NO: 92 | SEQ ID NO: 162 |
| SEQ ID NO: 20 | SEQ ID NO: 26 | SEQ ID NO: 96 | SEQ ID NO: 163 |
| SEQ ID NO: 24 | SEQ ID NO: 26 | SEQ ID NO: 98 | SEQ ID NO: 164 |
| SEQ ID NO: 20 | SEQ ID NO: 26 | SEQ ID NO: 98 | SEQ ID NO: 165 |
| SEQ ID NO: 24 | SEQ ID NO: 26 | SEQ ID NO: 96 | SEQ ID NO: 166 |

Fc regions for use in TFcAs may also comprise aa sequences that differ from those described herein, e.g., SEQ ID NOs:99-166, in one or more aa modifications, e.g., aa deletions, additions or substitutions. In certain embodiments, an Fc region comprises an aa sequence that differs from a sequence set forth herein, e.g., from a sequence selected from the group consisting of SEQ ID NOs:99-166, in at most, 1, 2, 3, 4, 5, 6, 7, 8, 9, 10, 15, 20, 25, 30, 35, 40, 45 or 50 aas. In certain embodiments, an Fc region comprises an aa sequence that is at least 70%, 75%, 80%, 85%, 90%, 95%, 97%, 98% or 99% identical to that of a sequence set forth herein, e.g., a sequence selected from the group consisting of SEQ ID NOs:99-166. For example, the CH3 domain of an Fc region consisting of an aa sequence selected from the group consisting of SEQ ID NOs:99-166 may comprise a deletion of the C-terminal lysine and/or E356D and/or M358L. As several antibody effector functions, e.g., ADCC and CDC, are mediated through Fc regions, aa changes that can be made to Fc regions include changes affecting the effector function(s) of Fc regions. Exemplary mutations to these domains are set forth herein. Any of these aa modifications are permitted provided that the Fc region retains the desired properties, e.g., biological activity, stability and low immunogenicity.

Exemplary Fc modifications affecting effector activity

TFcAs may comprise TFcs comprising aa modifications affecting the effector activity of Fc regions. Exemplary aa modifications are set forth below.

Replacements of aa residues in the Fc portion to alter antibody effector function are known in the art (see, e.g., U.S. Pat. Nos. 5,648,260 and 5,624,821). The Fc portion of an antibody mediates several important effector functions e.g., cytokine induction, antibody-dependent cellular cytotoxicity ("ADCC"), phagocytosis, complement dependent cytotoxicity (CDC) and half-life/clearance rate of antibody and antigen-antibody complexes. In some cases these effector functions are desirable for a therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies.

In one embodiment, a TFcA retains one or more of, and preferably all of the following attributes: ADCC and antibody-dependent cellular phagocytosis (ADCP) that in humans are determined by interactions with activating FcγRI, FcγRIIa/c, FcγRIIIa and inhibitory FcγRIIb receptors; CDC that is triggered by antibody binding to the components of the complement system; and long half-life that is mediated via active recycling by the neonatal Fc receptor (FcRn). When desired, all of these functions can be tuned to optimize the effectiveness of an anti-cancer therapy.

Certain aa modifications, e.g., the addition, deletion and/or substitution of one or more aas may be made to an immunoglobulin constant region to reduce or increase the natural biological activities of the constant domains, such as those set forth above.

In certain embodiments, a TFcA (e.g., a TFcBA) comprises an aa modification (e.g., an aa substitution, addition or deletion) in an Fc region that alters one or more antigen-independent effector functions of the domain, e.g., the circulating half-life of a protein comprising the domain. Exemplary antibodies exhibit either increased or decreased binding to FcRn when compared to antibodies lacking such aa changes and, therefore, have an increased or decreased half-life in serum, respectively. Antibodies comprising Fc variants with improved affinity for FcRn are anticipated to have longer serum half-lives, whereas those comprising Fc variants with decreased FcRn binding affinity are expected to have shorter half-lives. In one embodiment, a TFcA with altered FcRn binding comprises at least one Fc region having one or more aa changes within the "FcRn binding loop" of an Fc region. The FcRn binding loop is comprised of aa residues 280-299 (EU) of a wild type, full length, Fc. In certain embodiments, a TFcA having altered FcRn binding affinity comprises at least one Fc region having one or more aa substitutions within the 15 Å FcRn "contact zone." The term 15 Å FcRn "contact zone" includes residues at the following positions of a wild type, full-length Fc domain: 243-261, 275-280, 282-293, 302-319, 336-348, 367, 369, 372-389, 391, 393, 408, 424-440 (EU). In certain embodiments, a TFcA having altered FcRn binding affinity comprises at least one Fc region (e.g., one or two Fc moieties) having one or more aa changes at an aa position corresponding to any one of the following EU positions: 256, 277-281, 283-288, 303-309, 313, 338, 342, 376, 381, 384, 385, 387, 434 (e.g., N434A or N434K), and 438. Exemplary aa changes that alter FcRn binding activity are disclosed in International PCT Publication No. WO05/047327.

Additional Fc modifications that enhance FcRn binding include substitutions at positions 259, 308, 428, and 434, e.g., 259I, 308F, 428L, 428M, 434S, 434H, 434F, 434Y, 434M, 428L/434S, 259I/308F and 259I/308F/428L. Other variants that increase Fc binding to FcRn include: 250E, 250Q, 428L, 428F, 250Q/428L (Hinton et al., 2004, J. Biol. Chem. 279(8): 6213-6216, Hinton et al. 2006 Journal of Immunology 176:346-356), 256A, 272A, 286A, 305A, 307A, 307Q, 311A, 312A, 376A, 378Q, 380A, 382A, 434A (Shields et al, Journal of Biological Chemistry, 2001, 276 (9):6591-6604), 252F, 252T, 252Y, 252W, 254T, 256S, 256R, 256Q, 256E, 256D, 256T, 309P, 311S, 433R, 433S, 433I, 433P, 433Q, 434H, 434F, 434Y, 252Y/254T/256E, 433K/434F/436H, 308T/309P/311S (Dall Acqua et al. Journal of Immunology, 2002, 169:5171-5180, Dall'Acqua et al., 2006, Journal of Biological Chemistry 281:23514-23524). Other modifications for modulating FcRn binding are described in Yeung et al., 2010, J Immunol, 182:7663-7671.

In some embodiments, a TFcA comprises an Fc variant comprising an aa change that alters the antigen-dependent effector functions of the polypeptide, in particular ADCC or complement activation, e.g., as compared to a wild type Fc region. In exemplary embodiment, said antibodies exhibit altered binding to an Fc gamma receptor (e.g., CD16). Such antibodies exhibit either increased or decreased binding to FcγRs when compared to wild type polypeptides and, therefore, mediate enhanced or reduced effector function, respectively. Fc variants with improved affinity for FcγRs are anticipated to enhance effector function, and such proteins may have useful applications in methods of treating mammals where target molecule destruction is desired, e.g., in tumor therapy. In contrast, Fc variants with decreased FcγR binding affinity are expected to reduce effector function. In one embodiment, a TFcA comprises at least one altered antigen-dependent effector function selected from the group consisting of opsonization, phagocytosis, complement dependent cytotoxicity, antigen-dependent cellular cytotoxicity (ADCC), or effector cell modulation as compared to a TFcA comprising a wild type Fc region.

In certain embodiments, a TFcA exhibits altered binding to an activating FcγR (e.g. FcγRI, FcγRIIa, or FcγRIIIa). In certain embodiments, a TFcA exhibits altered binding affinity to an inhibitory FcγR (e.g. FcγRIIb). In other embodiments, a TFcA having increased FcγR binding affinity (e.g. increased FcγRIIIa binding affinity) comprises at least one Fc domain having an aa change at an aa position corresponding to one or more of the following positions: 239, 268, 298, 332, 334, and 378 (EU). In certain embodiments, a TFcA having decreased FcγR binding affinity (e.g. decreased FcγRI, FcγRII, or FcγRIIIa binding affinity) comprises at least one Fc domain having an aa substitution at an aa position corresponding to one or more of the following positions: 234, 236, 239, 241, 251, 252, 261, 265, 268, 293, 294, 296, 298, 299, 301, 326, 328, 332, 334, 338, 376, 378, and 435 (EU).

In certain embodiments, a TFcA having increased complement binding affinity (e.g. increased C1q binding affinity) comprises an Fc domain having an aa change at an aa position corresponding to one or more of the following positions: 251, 334, 378, and 435 (EU). In certain embodiments, a TFcA having decreased complement binding affinity (e.g. decreased C1q binding affinity) comprises an Fc domain having an aa substitution at an aa position corresponding to one or more of the following positions: 239, 294, 296, 301, 328, 333, and 376 (EU). Exemplary aa changes that alter FcγR or complement binding activity are disclosed in International PCT Publication No. WO05/063815. In certain embodiments, a TFcA may comprise one or more of the following specific Fc region substitutions: S239D, S239E, M252T, H268D, H268E, I332D, I332E, N434A, and N434K (EU).

Other Fc variants that reduce binding to FcγRs and/or complement include variants comprising one or more of the following aa substitutions: 34G, 235G, 236R, 237K, 267R, 269R, 325L, 328R, 236R/328R, 297A, 234A, 235A, 237A, 318A, 228P, 236E, 268Q, 309L, 330S, 331 S, 220S, 226S, 229S, 238S, 233P, and 234V. Removal of the glycosylation at position 297 (see below) also reduces binding to FcγRs.

Fc modifications that improve binding to FcγRs and/or complement include variants comprising one or more of the following aa substitutions: 236A, 239D, 239E, 268D, 267E, 268E, 268F, 324T, 332D, and 332E. Preferred variants include but are not limited to 239D/332E, 236A/332E, 236A/239D/332E, 268F/324T, 267E/268F, 267E/324T, and 267E/268F/324T. Other modifications for enhancing FcγR and complement interactions include but are not limited to substitutions 298A, 333A, 334A, 326A, 247I, 339D, 339Q, 280H, 290S, 298D, 298V, 243L, 292P, 300L, 396L, 305I, and 396L.

Variants that improve binding to FcγRIIb include variants comprising one or more of the following aa substitutions: 234D, 234E, 234W, 235D, 235F, 235R, 235Y, 236D, 236N, 237D, 237N, 239D, 239E, 266M, 267D, 267E, 268D, 268E, 327D, 327E, 328F, 328W, 328Y and 332E, 235Y/267E, 236D/267E, 239D/268D, 239D/267E, 267E/268D, 267E/268E, and 267E/328F.

Fc modifications modulating Fc are described in Strohl, 2009, Current Opinion in Biotechnology 20:685-691.

A TFcA may also comprise an aa substitution that alters the glycosylation of the TFcA. For example, an immunoglobulin constant region of a TFcA may comprise an Fc domain having a mutation leading to reduced glycosylation (e.g., N- or O-linked glycosylation) or may comprise an altered glycoform of the wild type Fc domain (e.g., a low fucose or fucose-free glycan). An "engineered glycoform" refers to a carbohydrate composition that is covalently attached to an Fc region, wherein said carbohydrate composition differs chemically from that of a parent Fc region. Engineered glycoforms may be useful for a variety of purposes, including but not limited to enhancing or reducing effector function. Engineered glycoforms may be generated by a variety of methods known in the art (U.S. Pat. No. 6,602,684; US Pat Pub No. 2010-0255013; US Pat Pub No. 2003-0003097; WO 00/61739A1; WO 01/29246A1; WO 02/31140A1; WO 02/30954A1); (Potelligent technology (Biowa, Inc., Princeton, N.J.); and GlycoMAb glycosylation engineering technology (Glycart Biotechnology AG, Zurich, Switzerland). Many of these techniques are based on controlling the level of fucosylated and/or bisecting oligosaccharides that are covalently attached to the Fc region, for example by expressing an Fc polypeptide in various organisms or cell lines, engineered or otherwise (for example Lec-13 CHO cells or rat hybridoma YB2/0 cells), by regulating enzymes involved in the glycosylation pathway (for example FUT8 [al, 6-fucosyltranserase] and/or (31-4-N-acetylglucosaminyl, transferase III [GnTIII]), or by modifying carbohydrate(s) after the Fc polypeptide has been expressed.

In exemplary embodiments, an aa change, e.g., an aa substitution, results in an Fc region comprising reduced glycosylation of the N-linked glycan normally found at aa position 297 (EU). The Fc region may also comprise a low fucose or fucose free glycan at aa position 297 (EU). In certain embodiments, the TFcA has an aa substitution near or within a glycosylation motif, for example, an N-linked glycosylation motif that contains the aa sequence NXT or NXS. In a particular embodiment, a TFcA comprises an aa substitution at an aa position corresponding to 297 or 299 of Fc (EU) as further described herein. Exemplary aa substitutions that reduce or alter glycosylation are disclosed in International PCT Publication No. WO05/018572 and US Pat Pub No. 2007/0111281.

In other embodiments, a TFcA comprises at least one Fc domain having one or more engineered cysteine residues or analog thereof that are located at the solvent-exposed surface. Preferably the engineered cysteine residue or analog thereof does not interfere with the desired biological activity of the TFcA. For example, it may be desirable that the alteration does not interfere with the ability of the Fc to bind to Fc receptors (e.g. FcγRI, FcγRII, or FcγRIII) or complement proteins (e.g. C1q), or to trigger immune effector function (e.g., antibody-dependent cytotoxicity (ADCC), phagocytosis, or CDC). In certain embodiments, TFcAs comprise an Fc domain comprising at least one engineered free cysteine residue or analog thereof that is substantially free of disulfide bonding with a second cysteine residue. TFcAs may comprise an Fc region having engineered cysteine residues or analogs thereof at one or more of the following positions in the CH3 domain: 349-371, 390, 392, 394-423, 441-446, and 446b (EU), and more specifically positions 350, 355, 359, 360, 361, 389, 413, 415, 418, 422, 441, 443, and EU position 446b.

Desired effector functions may also be obtained by choosing an Fc from a particular immunoglobulin class or subclass, or by combining particular regions from particular immoglobulin classes or subclasses, e.g., IgG1, IgG2, etc. For example, since ADCC and CDC (through binding of IgG to the FcγRs and C1q, respectively) is mediated by residues located in the hinge and CH2 domain, and since IgG4 essentially lacks effector functions, an Fc constructed by combining the hinge and CH2 domain of IgG4 and the CH3 domain of IgG1 has much reduced effector functions. An IgG1/IgG3 hybrid variant may be constructed by substituting IgG1 positions in the CH2 and/or CH3 region with the amino acids from IgG3 at positions where the two isotypes differ. Thus a hybrid variant IgG antibody may be constructed that comprises one or more of the following substitutions: 274Q, 276K, 300F, 339T, 356E, 358M, 384S, 392N, 397M, 422I, 435R, and 436F. In certain embodiments, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed that comprises one or more of the following amino acid substations: 233E, 234L, 235L, -236G (referring to an insertion of a glycine at position 236), and 327A.

Exemplary TFc Linkers

A TFcA may comprise a TFc comprising a first Fc region that is linked to a second Fc region through a TFc linker A wide variety of linkers may be used provided that they are sufficiently flexible to allow proper folding of the TFc and of a TFcA comprising the TFc. In certain embodiments, a linker is biologically inert, e.g., mostly incapable of inducing a biological response, e.g., an immune response.

A TFc linker may be 1-10, 10-20, 20-30, 30-40, 40-50, 50-60, 60-70, 70-80, 80-90 or at least 90-100 aas long. The size of a TFc linker may depend on whether the second Fc region comprises a hinge, a portion thereof or no hinge at all. For example, when the second Fc region comprises a hinge, a shorter TFc linker may be used than when the second Fc region does not comprise a hinge. For example, when a second Fc region does not comprise a hinge, a TFc linker may be longer by a number of aas corresponding to the length of a hinge. When a second Fc region does not comprise an upper hinge, a TFc linker may be longer by a number of aas corresponding to the length of the upper hinge. In a preferred embodiment, a TFcA, e.g., a TFcA that comprises a second hinge consisting of a middle and lower hinge, comprises a TFc linker comprising from 35 to 45 aas, such as from 37 to 43 aas, such as from 38 to 42 aas, such as from 39 to 41 aas, and more particularly, 40 aas.

A TFc linker may comprise a Gly-Ser linker A "Gly-Ser linker" refers to a peptide that consists of glycine and serine residues. An exemplary Gly-Ser linker comprises an aa sequence having the formula $(Gly_4Ser)_n$ (SEQ ID NO: 493), wherein n is a positive integer (e.g., 1, 2, 3, 4, 5, 6, 7, 8, 9, 10, 11, 12, 13, 14, 15, 16, 17, 18, 19, 20). For example, in certain embodiments, a TFc linker comprises or consists of $(Gly_4Ser)_3$ (SEQ ID NO: 495) or $(Gly_4Ser)_4$ (SEQ ID NO: 496) or $(Gly_4Ser)_5$ (SEQ ID NO: 497) or $(Gly_4Ser)_6$ (SEQ ID NO: 498) or $(Gly_4Ser)_7$ (SEQ ID NO: 499) or $(Gly_4Ser)_8$ (SEQ ID NO: 491). In a preferred embodiment, the TFc linker is $(Gly_4Ser)_8$ (SEQ ID NO: 491.

Other linkers that may be used include those that comprise Gly and Ser, but not in a (G4S)n (SEQ ID NO: 503) structure. For example, linkers may comprise (Gly-Gly-Ser)n or (Gly-Ser-Gly-Ser)n (SEQ ID NO: 504), wherein n is 1, 2, 3, 4, 5, 6, 7, 8, 9, 10, 11, 12, 13, 14, 15 or more. Other linkers may comprise Pro or Thr. Suitable linkers may be found in the Registry of Standard Biological Parts at partsregistry.org/Protein_domains/Linker (see also, e.g., Crasto C J and Feng J A. LINKER: a program to generate linker sequences for fusion proteins. Protein Eng 2000 May; 13(5) 309-12 and George RA and Heringa J. An analysis of protein domain linkers: their classification and role in protein folding. Protein Eng 2002 Nov; 15(11) 871-9).

In certain embodiments, a TFc linker comprises the following aa sequence:

```
                                    (SEQ ID NO: 169)
TRPAPPSTATTAGSTPQPESASPSGKEPAASSPSSTNTGS
```

TFc linkers comprising an aa sequence that differs from SEQ ID NO:169 or from a $(G4S)_n$ (SEQ ID NO: 492) sequence in at most 1, 2, 3, 4, 5, 6, 7, 8, 9 or 10 aas may also be used.

A TFc linker may also be a non-peptide linker, such as a non-peptide polymer. The term "non-peptide polymer," refers to a biocompatible polymer including two or more repeating units linked to each other by a covalent bond excluding the peptide bond. Examples of the non-peptide polymer include poly (ethylene glycol), poly (propylene glycol), copolymers of ethylene glycol and propylene glycol, polyoxyethylated polyols, polyvinyl alcohol, polysaccharides, dextran, polyvinyl ether, biodegradable polymers such as PLA (poly (lactic acid) and PLGA (poly (lactic-glycolic acid), lipid polymers, chitins, and hyaluronic acid. The most preferred is poly (ethylene glycol) (PEG).

Exemplary TFcs

TFcAs may comprise a TFc comprising a first Fc region that is linked to a second Fc region through a TFc linker. In certain embodiments, a TFc comprises a first and a second Fc region that are identical to each other. In other embodiments, the first and the second Fc regions differ from each other in at least one aa ("heteromeric TFc"). A first and a second Fc region may be any Fc region disclosed herein or a variation thereof. For example, a TFc may comprise a first Fc region that comprises a full length hinge, e.g., a full length IgG1 or IgG1/IgG4 hybrid hinge, and a second Fc region that comprises a partial hinge, e.g., a hinge that is devoid of the upper hinge.

First and second Fc regions may be combined with any TFc linker described herein. As set forth above, generally the length of the TFc linker may depend on whether the second Fc region comprises a hinge, a portion thereof, or no hinge at all.

In certain embodiments, an IgG1 TFc comprises a first Fc region comprising SEQ ID NO:99 and a second Fc region comprising SEQ ID NO:100. Combinations of first and second Fc regions that may be used in IgG1 TFcs are set forth in Table 10.

TABLE 10

Exemplary combinations of first and second Fc regions (shown in FIG. 4) for use in IgG1 TFcs

| First Fc region | Second Fc region |
|---|---|
| SEQ ID NO: 99 | SEQ ID NO: 100 |
| SEQ ID NO: 101 | SEQ ID NO: 102 |
| SEQ ID NO: 103 | SEQ ID NO: 104 |
| SEQ ID NO: 105 | SEQ ID NO: 106 |
| SEQ ID NO: 107 | SEQ ID NO: 108 |
| SEQ ID NO: 109 | SEQ ID NO: 110 |
| SEQ ID NO: 111 | SEQ ID NO: 112 |
| SEQ ID NO: 113 | SEQ ID NO: 114 |
| SEQ ID NO: 115 | SEQ ID NO: 116 |
| SEQ ID NO: 117 | SEQ ID NO: 118 |
| SEQ ID NO: 119 | SEQ ID NO: 120 |
| SEQ ID NO: 121 | SEQ ID NO: 122 |
| SEQ ID NO: 123 | SEQ ID NO: 124 |
| SEQ ID NO: 125 | SEQ ID NO: 126 |
| SEQ ID NO: 127 | SEQ ID NO: 128 |
| SEQ ID NO: 129 | SEQ ID NO: 130 |
| SEQ ID NO: 131 | SEQ ID NO: 132 |

In certain embodiments, an IgG1/IgG4 hybrid TFc comprises a first Fc region comprising SEQ ID NO:133 and a second Fc region comprising SEQ ID NO:134. Combinations of first and second Fc regions that may be used in IgG1/IgG4 hybrid TFcs are set forth in Table 11.

TABLE 11

Exemplary combinations of first and second Fc regions (shown in FIG. 5) for use in IgG1/IgG4 TFcs

| First Fc region | Second Fc region |
|---|---|
| SEQ ID NO: 133 | SEQ ID NO: 134 |
| SEQ ID NO: 135 | SEQ ID NO: 136 |
| SEQ ID NO: 137 | SEQ ID NO: 138 |
| SEQ ID NO: 139 | SEQ ID NO: 140 |
| SEQ ID NO: 141 | SEQ ID NO: 142 |
| SEQ ID NO: 143 | SEQ ID NO: 144 |
| SEQ ID NO: 145 | SEQ ID NO: 146 |
| SEQ ID NO: 147 | SEQ ID NO: 148 |

TABLE 11-continued

Exemplary combinations of first and second Fc regions (shown in FIG. 5) for use in IgG1/IgG4 TFcs

| First Fc region | Second Fc region |
|---|---|
| SEQ ID NO: 149 | SEQ ID NO: 150 |
| SEQ ID NO: 151 | SEQ ID NO: 152 |
| SEQ ID NO: 153 | SEQ ID NO: 154 |
| SEQ ID NO: 155 | SEQ ID NO: 156 |
| SEQ ID NO: 157 | SEQ ID NO: 158 |
| SEQ ID NO: 159 | SEQ ID NO: 160 |
| SEQ ID NO: 161 | SEQ ID NO: 162 |
| SEQ ID NO: 163 | SEQ ID NO: 164 |
| SEQ ID NO: 165 | SEQ ID NO: 166 |

A TFc may comprise a combination of two Fcs set forth in Table 10 or 11, which are linked together through a TFc linker to form a contiguous polypeptide comprising in amino to carboxyl terminal order: a first Fc region, which is linked at its C-terminus to the N-terminus of a TFc linker, which is linked at its C-terminus to the N-terminus of the second Fc region. The TFc linker may comprise or consist of 20 to 50 amino acids in length.

Exemplary TFcs may comprise: i) a first Fc region comprising a hinge comprising SEQ ID NO:4, a CH2 domain comprising SEQ ID NO:25, a CH3 domain comprising SEQ ID NO:33; ii) a TFc linker comprising $(G_4S)_8$ (SEQ ID NO: 491); and iii) a second Fc region comprising a hinge comprising SEQ ID NO:23, a CH2 domain comprising SEQ ID NO:25 and a CH3 domain comprising SEQ ID NO:37. An exemplary IgG1 TFc comprising this set of elements is a TFc comprising SEQ ID NO:171. Additional combinations of domains or elements forming IgG1 and IgG1/IgG4 hybrid TFcs are provided in Table 12 and 13, respectively. Each of the elements or domains in Tables 12 and 13 is referred to by its SEQ ID NO and the specific AEM and/or DiS that it comprises. Each of the domains or elements in Tables 12 and 13 may be linked directly or indirectly.

The aa sequence of each of the TFcs listed in Table 12 (SEQ ID NOs:171, 173, 175, 177, 179, 181, 183, 185, 187, 189, 191, 193 and 195) is provided in FIG. 6. The aa sequence of each of the TFcs listed in Table 13 (SEQ ID NOs:197, 199, 201, 203, 205, 207, 209, 211, 213, 215, 217, 219 and 221) is provided in FIG. 7. The first column of Tables 12 and 13 lists the name and SEQ ID NO of an exemplary TFc comprising the elements listed in the corresponding row of the Table.

TABLE 12

IgG1 TFcs set forth in FIG. 6 ("$(G_4S)_8$," "$(G_4S)_4$," "$(G_4S)_7$," "$(G_4S)_6$," and "$(G_4S)_5$" disclosed as SEQ ID NOS 491, 496, 499, 498 and 497, respectively)
IgG1 TFc

| | First Fc | | | TFc | Second Fc | | |
|---|---|---|---|---|---|---|---|
| | Hinge | CH2 | CH3 | linker | Hinge | CH2 | CH3 |
| 23 SEQ ID NO: 171 | SEQ ID NO: 4 wild type | SEQ ID NO: 25 | SEQ ID NO: 33 T366S/L368A/Y407V | $(G_4S)_8$ | SEQ ID NO: 23 partial | SEQ ID NO: 25 | SEQ ID NO: 37 T366W |
| 23A SEQ ID NO: 173 | SEQ ID NO: 4 wild type | SEQ ID NO: 25 | SEQ ID NO: 77 Y349C/T366S/L368A/Y407V | $(G_4S)_8$ | SEQ ID NO: 23 partial | SEQ ID NO: 25 | SEQ ID NO: 81 S354C/T366W |
| 23B SEQ ID NO: 175 | SEQ ID NO: 4 wild type | SEQ ID NO: 25 | SEQ ID NO: 41 Y407T | $(G_4S)_8$ | SEQ ID NO: 23 partial | SEQ ID NO: 25 | SEQ ID NO: 45 T366Y |

TABLE 12-continued

IgG1 TFcs set forth in FIG. 6 ("$(G_4S)_8$," "$(G_4S)_4$," "$(G_4S)_7$," "$(G_4S)_6$," and "$(G_4S)_5$" disclosed as SEQ ID NOS 491, 496, 499, 498 and 497, respectively)
IgG1 TFc

| | First Fc | | | TFc | Second Fc | | |
|---|---|---|---|---|---|---|---|
| | Hinge | CH2 | CH3 | linker | Hinge | CH2 | CH3 |
| 23C SEQ ID NO: 177 | SEQ ID NO: 18 H224C/ T225C | SEQ ID NO: 25 | SEQ ID NO: 33 T366S/L368A/ Y407V | $(G_4S)_8$ | SEQ ID NO: 23 partial | SEQ ID NO: 25 | SEQ ID NO: 37 T366W |
| 23D SEQ ID NO: 179 | SEQ ID NO: 19 T223C | SEQ ID NO: 25 | SEQ ID NO: 33 T366S/L368A/ Y407V | $(G_4S)_8$ | SEQ ID NO: 23 partial | SEQ ID NO: 25 | SEQ ID NO: 37 T366W |
| 23E SEQ ID NO: 181 | SEQ ID NO: 4 wild type | SEQ ID NO: 25 | SEQ ID NO: 84 T366S/L368A/ Y407V/C-term Cysteine | $(G_4S)_8$ | SEQ ID NO: 23 partial | SEQ ID NO: 25 | SEQ ID NO: 86 T366W/C-term Cysteine |
| 23G SEQ ID NO: 183 | SEQ ID NO: 4 wild type | SEQ ID NO: 25 | SEQ ID NO: 33 T366S/L368A/ Y407V | $(G_4S)_4$ | SEQ ID NO: 23 partial | SEQ ID NO: 25 | SEQ ID NO: 37 T366W |
| 23E (35L) SEQ ID NO: 185 | SEQ ID NO: 4 wild type | SEQ ID NO: 25 | SEQ ID NO: 84 T366S/L368A/ Y407V/C-term Cysteine | $(G_4S)_7$ | SEQ ID NO: 23 partial | SEQ ID NO: 25 | SEQ ID NO: 86 T366W/C-term Cysteine |
| 23E (35L) Inv SEQ ID NO: 187 | SEQ ID NO: 4 wild type | SEQ ID NO: 25 | SEQ ID NO: 88 T366S/L368A/ Y407V/C-term Cysteine Inv | $(G_4S)_7$ | SEQ ID NO: 23 partial | SEQ ID NO: 25 | SEQ ID NO: 90 T366W/C-term Cysteine Inv |
| 23E (30L) SEQ ID NO: 189 | SEQ ID NO: 4 wild type | SEQ ID NO: 25 | SEQ ID NO: 84 T366S/L368A/ Y407V/C-term Cysteine | $(G_4S)_6$ | SEQ ID NO: 23 partial | SEQ ID NO: 25 | SEQ ID NO: 86 T366W/C-term Cysteine |
| 23E (25L) SEQ ID NO: 191 | SEQ ID NO: 4 wild type | SEQ ID NO: 25 | SEQ ID NO: 84 T366S/L368A/ Y407V/C-term Cysteine | $(G_4S)_5$ | SEQID NO: 23 partial | SEQ ID NO: 25 | SEQ ID NO: 86 T366W/C-term Cysteine |
| 23I SEQ ID NO: 193 | SEQ ID NO: 4 wild type | SEQ ID NO: 25 | SEQ ID NO: 92 S364H/F405A | $(G_4S)_8$ | SEQ ID NO: 23 partial | SEQ ID NO: 25 | SEQ ID NO: 94 Y349T/T394F |
| 23J SEQ ID NO: 195 | SEQ ID NO: 4 wild type | SEQ ID NO: 25 | SEQ ID NO: 96 K370D/K392D/ K409D | $(G_4S)_8$ | SEQ ID NO: 23 partial | SEQ ID NO: 25 | SEQ ID NO: 98 D356K/E357K/D 399K |

TABLE 13

IgG1/IgG4 hybrid TFcs set forth in FIG. 7 ("$(G_4S)_8$," "$(G_4S)_4$," "$(G_4S)_7$," "$(G_4S)_6$" and "$(G_4S)_5$" disclosed as SEQ ID NOS 491, 496, 499, 498 and 497, respectively)
IgG1/IgG4 hybrid TFc

| | First Fc | | | TFc | Second Fc | | |
|---|---|---|---|---|---|---|---|
| | Hinge | CH2 | CH3 | linker | Hinge | CH2 | CH3 |
| 39 SEQ ID NO: 197 | SEQ ID NO: 20 wild type | SEQ ID NO: 26 | SEQ ID NO: 33 T366S/L368A/ Y407V | $(G_4S)_8$ | SEQ ID NO: 24 partial | SEQ ID NO: 26 | SEQ ID NO: 37 T366W |
| 39A SEQ ID NO: 199 | SEQ ID NO: 20 wild type | SEQ ID NO: 26 | SEQ ID NO: 77 Y349C/T366S/ L368A/Y407V | $(G_4S)_8$ | SEQ ID NO: 24 partial | SEQ ID NO: 26 | SEQ ID NO: 81 S354C/T366W |
| 39B SEQ ID NO: 201 | SEQ ID NO: 20 wild type | SEQ ID NO: 26 | SEQ ID NO: 41 Y407T | $(G_4S)_8$ | SEQ ID NO: 24 partial | SEQ ID NO: 26 | SEQ ID NO: 45 T366Y |
| 39C SEQ ID NO: 203 | SEQ ID NO: 21 H224C/ T225C | SEQ ID NO: 26 | SEQ ID NO: 33 T366S/L368A/ Y407V | $(G_4S)_8$ | SEQ ID NO: 24 partial | SEQ ID NO: 26 | SEQ ID NO: 37 T366W |
| 23D SEQ ID NO: 205 | SEQ ID NO: 22 T223C | SEQ ID NO: 26 | SEQ ID NO: 33 T366S/L368A/ Y407V | $(G_4S)_8$ | SEQ ID NO: 24 partial | SEQ ID NO: 26 | SEQ ID NO: 37 T366W |
| 39E SEQ ID NO: 207 | SEQ ID NO: 20 wild type | SEQ ID NO: 26 | SEQ ID NO: 84 T366S/L368A/ Y407V/C-term Cysteine | $(G_4S)_8$ | SEQ ID NO: 24 partial | SEQ ID NO: 26 | SEQ ID NO: 86 T366W/C-term Cysteine |

TABLE 13-continued

IgG1/IgG4 hybrid TFcs set forth in FIG. 7 ("$(G_4S)_8$," "$(G_4S)_4$," "$(G_4S)_7$," "$(G_4S)_6$" and "$(G_4S)_5$" disclosed as SEQ ID NOS 491, 496, 499, 498 and 497, respectively)

IgG1/IgG4 hybrid TFc

| | First Fc | | | TFc | Second Fc | | |
|---|---|---|---|---|---|---|---|
| | Hinge | CH2 | CH3 | linker | Hinge | CH2 | CH3 |
| 39G SEQ ID NO: 209 | SEQ ID NO: 20 wild type | SEQ ID NO: 26 | SEQ ID NO: 33 T366S/L368A/ Y407V | $(G_4S)_4$ | SEQ ID NO: 24 partial | SEQ ID NO: 26 | SEQ ID NO: 37 T366W |
| 39E (35L) SEQ ID NO: 211 | SEQ ID NO: 20 wild type | SEQ ID NO: 26 | SEQ ID NO: 84 T366S/L368A/ Y407V/C-term Cysteine | $(G_4S)_7$ | SEQ ID NO: 24 partial | SEQ ID NO: 26 | SEQ ID NO: 86 T366W/C-term Cysteine |
| 39E (35L) Inv SEQ ID NO: 213 | SEQ ID NO: 20 wild type | SEQ ID NO: 26 | SEQ ID NO: 88 T366S/L368A/ Y407V/C-term Cysteine Inv | $(G_4S)_7$ | SEQ ID NO: 24 partial | SEQ ID NO: 26 | SEQ ID NO: 90 T366W/C-term Cysteine Inv |
| 39E (30L) SEQ ID NO: 215 | SEQ ID NO: 20 wild type | SEQ ID NO: 26 | SEQ ID NO: 84 T366S/L368A/ Y407V/C-term Cysteine | $(G_4S)_6$ | SEQ ID NO: 24 partial | SEQ ID NO: 26 | SEQ ID NO: 86 T366W/C-term Cysteine |
| 39E (25L) SEQ ID NO: 217 | SEQ ID NO: 20 wild type | SEQ ID NO: 26 | SEQ ID NO: 84 T366S/L368A/ Y407V/C-term Cysteine | $(G_4S)_5$ | SEQ ID NO: 24 partial | SEQ ID NO: 26 | SEQ ID NO: 86 T366W/C-term Cysteine |
| 39I SEQ ID NO: 219 | SEQ ID NO: 20 wild type | SEQ ID NO: 26 | SEQ ID NO: 92 S364H/F405A | $(G_4S)_8$ | SEQ ID NO: 24 partial | SEQ ID NO: 26 | SEQ ID NO: 94 Y349T/T394F |
| 39J SEQ ID NO: 221 | SEQ ID NO: 20 wild type | SEQ ID NO: 26 | SEQ ID NO: 96 K370D/K392D/ K409D | $(G_4S)_8$ | SEQ ID NO: 24 partial | SEQ ID NO: 26 | SEQ ID NO: 98 D356K/E357K/D 399K |

In certain embodiments, a TFc comprises an aa sequence that differs from that of a TFc described herein, e.g., an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221, in at most 10, 20, 30, 40, 50, 60, 70, 80, 90, 100, 150, 200, 250 or 300 aas, provided that the TFc has the desired biological activity, such as effector function or lack thereof, proper folding, sufficient stability and solubility. Differences may be one or more aa insertions, deletions and/or substitutions. In certain embodiments, a TFc comprises an aa sequence that is at least about 70%, 75%, 80%, 85%, 90%, 95%, 97%, 98%, or 99% identical to that of a TFc described herein, e.g., an aa sequence selected from the group consisting of SEQ ID NOs:171, 173, 175, 177, 179, 181, 183, 185, 187, 189, 191, 193, 195, 197, 199, 201, 203, 205, 207, 209, 211, 213, 215, 217, 219 and 221, provided that the TFcA comprising the TFc has the desired biological activity, such as effector function or lack thereof, proper folding, sufficient stability and/or sufficient solubility.

Exemplary Binding Sites

A TFcA may be a monovalent TFcA that comprises a single binding site. The single binding site may be located a the amino terminus or carboxyl terminus of the TFc. The single binding site may be a Fab or an scFv. When the single binding site is a Fab, the monovalent TFcA comprises a heavy chain comprising the VH domain and optionally a CH1 domain and a light chain comprising the VL domain and optionally a CL domain.

A TFcA may also be a TFcBA comprising two binding sites, e.g., wherein each binding site binds to the same or to a different epitope or antigen (a bivalent monospecific of bispecific TFcA). The binding sites of a TFcBA may be of the same type or of a different type. For example, both binding sites may be TFcs, both binding sites may be Fabs, one binding site may be a Fab and the other binding site may be an scFv. Single domain binding sites may also be used. A Fab will generally comprise a VH domain, which may be linked to a CH1 domain on the heavy chain of a TFcBA and a VL domain, which may be linked to a CL domain on the light chain of the molecule. An scFv will generally comprise a VH domain linked to an scFv linker that is linked to a VL domain.

An scFv may be connected to a TFc by a connecting linker A connecting linker may be about 1-5, 1-10, 1-15, 1-20 aas long or longer. A connecting linker is preferably chemically inert, non immunogenic and has the required flexibility and rigidity for allowing the proper conformation of a TFcBA comprising the scFv. In one embodiment, a connecting linker comprises a Gly-Ser sequence, e.g., the aa sequence $(G_4S)_n$ (SEQ ID NO: 502), wherein n is 1, 2, 3, 4, or 5 or more. In one embodiment, a connecting linker comprises $(G_4S)_2$ (SEQ ID NO: 494) (see, e.g., FIG. 9).

An scFv comprises an scFv linker that links together the VH and the VL domains. An scFv linker may be 15-30 or 20-25 aa long. An scFv linker is preferably chemically inert, non immunogenic and has the required flexibility and rigidity for allowing the proper conformation of a TFcBA comprising the scFv. In one embodiment, an scFv linker comprises a Gly-Ser sequence, e.g., the aa sequence $(G_4S)_n$ (SEQ ID NO: 502), wherein n is 1, 2, 3, 4, or 5 or more. However, other sequences may also be used. In certain embodiments, an scFv linker may comprise a portion of a hinge or a full length hinge alone or together with other aas, such as a $(G_4S)_n$ (SEQ ID NO: 492) sequence. In certain embodiments, an scFv linker comprises the sequence "AST" (the first 3 aa of a CH1 domain) upstream of a peptide linker, such as a Gly-Ser linker, e.g., $(G_4S)_4$ (SEQ ID NO: 496) (see, e.g., FIG. 9).

In certain embodiments, a TFcA does not comprise a first and/or a second hinge. Instead of a hinge, a TFcA may comprise a connecting linker. Such a linker may be a Gly-Ser linker as further described herein in the context of TFc linkers. An exemplary connecting linker may be shorter than a TFc linker. In certain embodiments, a connecting linker comprises a $(G_4S)_3$ (SEQ ID NO: 495) or $(G_4S)_4$ (SEQ ID NO: 496) sequence. In certain embodiments, a connecting linker comprises a portion of a hinge, e.g., an upper hinge, middle hinge, lower hinge, or a combination thereof or a portion of one of these and another peptide sequence, such as a $(G_4S)_n$ (SEQ ID NO: 502) sequence, wherein n is 1, 2, 3, 4 or 5. Other peptide sequences may also be used as a connecting linker provided that they provide the required flexibility and rigidity of certain parts of the linker In certain embodiments, a binding site is an antigen binding site, such as a Fab, scFv or single domain. Exemplary TFcAs comprise one or more VH and/or VL CDRs such as those from one or more of the variable regions provided herein. In certain embodiments, an anti-c-Met binding site comprises a VHCDR3 and/or a VLCDR3 sequence set forth in FIG. 9, such as those of the variable domains of the humanized antibody 5D5 (US2006/0134104) or the anti-c-Met binding site 2 (see Example 3). In certain embodiments, an anti-c-Met binding site comprises 1, 2 or 3 CDRs of one of the VH domains set forth in FIG. 9 and/or 1, 2 or 3 CDRs of the VL domain set forth in FIG. 9. In certain embodiments, an anti-EGFR binding site comprises a VHCDR3 and/or a VLCDR3 sequence set forth in FIG. 9. In certain embodiments, an anti-EGFR binding site comprises 1, 2 or 3 CDRs of one of the VH domains set forth in FIG. 9 and/or 1, 2 or 3 CDRs of one of the VL domains set forth in FIG. 9. Binding sites may also comprise one or more CDRs set forth in FIG. 9, wherein 1, 2 or 3 aas have been changed, e.g., substituted, added or deleted, provided that the binding sites are still able to bind specifically to their target.

In certain embodiments, TFcAs comprise one or more variable domains set forth in FIG. 9. For example, an anti-c-Met binding site may comprise a VH and/or VL sequence set forth in FIG. 9, such as the variable domains of the humanized antibody 5D5 (US2006/0134104) or the anti-c-Met binding site 2. Exemplary anti-EGFR binding sites comprise a VH and/or a VL sequence set forth in FIG. 9, such as those of panitumumab, 2224, cetuximab or humanized cetuximab H1L1, H1L2, H2L1 or H2L2 (see Example 3).

In certain embodiments, anti-c-Met/anti-EGFR TFcAs comprise an anti-c-Met Fab and an anti-EGFR scFv. Table 14 shows combinations of CDRs or variable domains of each of the following anti-c-Met and anti-EGFR aa sequences that may be used for forming TFcAs. The Table provides a SEQ ID NO if the sequence is provided herein or a "yes" if a combination is possible, but the resulting aa sequence is not specifically provided. A person of skill in the art will be able to create such a molecule without undue experimentation based on the fact that all the elements of such proteins and nucleotide sequences encoding such are provided herein.

TABLE 14

Heavy chains of exemplary TFcAs

| | | Anti-c-Met Fab | |
|---|---|---|---|
| | | Humanized 5D5 | Binding site 2 |
| Anti-EGFR scFv | panitumumab | SEQ ID NO: 235, 343, 225, 227 and 229 | yes |
| | 2224 | SEQ ID NO: 239 | yes |
| | cetuximab H1L1 | SEQ ID NO: 260 | SEQ ID NO: 291 |
| | cetuximab H1L2 | SEQ ID NO: 281 | yes |
| | cetuximab H2L1 | SEQ ID NO: 283 | yes |
| | cetuximab H2L2 | SEQ ID NO: 285 | yes |

Light chains that may be used with the heavy chains in Table 14 are the light chains of the particular anti-c-Met Fab used in the TFcA. For example, a TFcA comprising a VH domain from humanized 5D5, e.g., TFcAs comprising any one of SEQ ID NOs:225, 227, 229, 235, 239, 260, 281, 283, 285 and 342, may be used with a light chain comprising the VL domain of humanized 5D5, i.e., SEQ ID NO:231. A TFcA comprising a VH domain from the anti-c-Met binding site 2, e.g., TFcAs comprising SEQ ID NO:291, may be used with a light chain comprising the VH domain of the anti-c-Met binding site 2, e.g., the VL domain of SEQ ID NO:289.

Antigen binding sites, e.g., the ones described herein, may be engineered for enhanced stability, reduced heterogeneity, enhanced expression, enhanced solubility or other desirable characteristic. Methods for engineering of antibody fragments, such as scFv, VH, VL, and Fab with enhanced stability and increased expression are described, e.g., in US 2006/0127893 US 2009/0048122 and references therein.

Variable domains may differ from those set forth herein in, or in at most, 1, 2, 3, 4, 5, 6, 7, 8, 9, 10, 15, 20, 25, 30, 50, 100 aas, provided that a binding site with a modified variable region retains its ability to bind specifically to its target antigen, e.g., a human antigen selected from c-MET, ErbB2, ErbB3, ErbB4, IGF1R, IGF2R, Insulin receptor, RON, EGFR, VEGFR1, VEGFR2, TNFR, FGFR1-4, PDGFR (alpha and beta), c-Kit, EPCAM and EphA2. Variable domains for use in TFcAs, e.g., TFcBAs, may also comprise a VH or VL aa sequence that is at least 70%, 75%, 80%, 85%, 90%, 95%, 97%, 98% or 99% identical to the VH or VL aa sequence set forth in FIG. 9, provided that a binding site with a modified variable domain retains its ability to bind specifically to its target antigen.

Anti-c-METand/or anti-EGFR TFcBAs may also comprise a binding site that binds to the same epitope on human c-Met or human EGFR as the binding sites provided herein, such as the ones having sequences set forth in FIG. 9. Binding sites encompassed herein may also competitively block or compete with the binding of a binding site described herein, such as the ones having sequences set forth in FIG. 9. A TFcA comprising a binding site that competes with a binding site described herein for binding to a target antigen or epitope include the binding sites that are capable of displacing a reference binding site (e.g., as described herein), e.g., when added in an ELISA after the reference binding site, as well as binding sites that prevent a reference binding site from binding when the binding site is added after the reference binding site to an ELISA.

TFcAs may also comprise variable domains from anti-c-Met, anti-c-Kit, anti-ErbB2, anti-ErbB3, anti-ErbB4, anti-IGF1R, anti-IGF2R, anti-Insulin receptor, anti-RON, anti-VEGFR1, anti-VEGFR2, anti-TNFR, anti-FGFR1, anti-FGFR2, anti-FGFR3, anti-FGFR4, anti-PDGFR alpha, anti-PDGFR beta, anti-EPCAM, anti-EphA2 or anti-EGFR antibodies known in the art. Known anti-c-Met antibodies are set forth in U.S. Pat. No. 5,686,292, U.S. Pat. No. 7,476,724, WO 2004/072117, WO 2004/108766, WO 2005/016382, WO 2005/063816, WO 2006/015371, WO 2006/104911, WO 2007/126799, and WO 2009/007427. Exemplary known anti-EGFR antibodies include ABX-EGF (Abgenix) (Yang, X. D., et al., Crit. Rev. Oncol./Hematol. 38 (2001) 17-23) and humanized ICR62 (WO 2006/082515). Exemplary anti-c-Kit antibodies are set forth in U.S. Pat. No. 7,915,391 and EP 0586445B1. Exemplary anti-ErbB2 antibodies are set forth in U.S. Pat. No. 5,821,337 and U.S. Pat. No. 7,560,111. Exemplary anti-ErbB3 antibodies are set forth in U.S. Pat. No. 7,705,130, U.S. Pat. No. 7,846,440 and WO 2011/136911. Exemplary anti-ErbB4 antibodies are set forth in U.S. Pat. No. 7,332,579 and US 2010/0190964. Exemplary anti-IGF1R antibodies are set forth in U.S. Pat. No. 7,871,611 and U.S. Pat. No. 7,700,742. Exemplary anti-Insulin receptor antibodies are set forth in Bhaskar V. et al, Diabetes. 2012 May; 61(5):1263-71. Exemplary anti-RON antibodies are set forth in WO 2012/006341, US 2009/0226442, and U.S. Pat. No. 7,947,811. Exemplary anti-VEGFR1 antibodies are set forth in WO 2005/037235. Exemplary anti-VEGFR2 antibodies are set forth in U.S. Pat. No. 8,057,791 and U.S. Pat. No. 6,344,339. Exemplary anti-TNFR1 antibodies are set forth in EP 1972637B1 and US 2008/0008713. Exemplary anti-FGFR1 antibodies are set forth in Ronca R et al, Mol Cancer Ther; 9(12); 3244-53, 2010, and WO 2005/037235. Exemplary anti-FGFR2 antibodies are set forth in WO 2011/143318. Exemplary anti-FGFR3 antibodies are set forth in WO 2010/002862 and EP 1423428B1. Exemplary anti-FGFR4 antibodies are set forth in WO 03/063893, WO 2008/052796 and US 2010/0169992. Exemplary anti-PDGFR alpha antibodies are set forth in U.S. Pat. No. 8,128,929 and WO 1995/000659. Exemplary anti-PDGFR beta antibodies are set forth in U.S. Pat. No. 7,740,850. Exemplary anti-EPCAM antibodies are set forth in U.S. Pat. No. 7,976,842, US 2003/0157054, and WO 2001/007082. Exemplary anti-EphA2 antibodies are set forth in EP 1575509B1, U.S. Pat. No. 7,402,298, and U.S. Pat. No. 7,776,328. Exemplary CD-44m antibodies are set forth in U.S. Pat. No. 8,071,072, WO 2008/079246, U.S. Pat. No. 6,972,324. Exemplary CEA antibodies are set forth in U.S. Pat. No. 7,626,011. Exemplary ALK antibodies are set forth in U.S. Pat. No. 6,696,548, U.S. Pat. No. 7,902,340, and WO 2008/131575. Exemplary AXL antibodies are set forth in US 2010/0330095, US 2012/0121587, and WO 2011/159980.

In another embodiment, a binding site is a binding peptide. c-Met binding peptides are known e.g. from Matzke, A., et al., Cancer Res 65 (14) (2005) 6105-10. And Tam, Eric, M., et al., J. Mol. Biol. 385 (2009)79-90.

Binding sites preferably bind specifically to their target with Kd of $10^{-6}$, $10^{-7}$, $10^{-8}$, $10^{-9}$ M, or $10^{-10}$ M or an even lower Kd value, as measured, e.g., by surface plasmon resonance (e.g., using a BIAcore system).

TFcAs may bind specifically to any target protein, e.g., soluble or membrane human target proteins. Exemplary target proteins include human receptor proteins selected from the group consisting of ErbB2, ErbB3, ErbB4, IGF1R, IGF2R, Insulin receptor, RON, VEGFR1, VEGFR2, TNFR, FGFR1-4, PDGFR (alpha and beta), c-Kit, c-Met, EPCAM and EphA2.

Exemplary Heavy and Light Chains

In one embodiment, a TFcA comprises a heavy chain and a light chain. In one embodiment, an anti-c-Met/anti-EGFR TFcBA comprises a heavy chain comprising an aa sequence set forth in FIG. 9 and/or a light chain comprising an aa sequence set forth in Example 3.

TFcBAs may also comprise a heavy chain and/or a light chain that comprise an aa sequence that differs from an aa sequence set forth in FIG. 9 in, or in at most 1, 2, 3, 4, 5, 6, 7, 8, 9, 10, 15, 20, 25, 30, 50, 100, 200, or 300 aas, provided that the TFcBA has the desired biological characteristic(s), as further described herein. A TFcBAs may also comprise a heavy chain and/or a light chain comprising an aa sequence that is at least 70%, 75%, 80%, 85%, 90%, 95%, 97%, 98% or 99% identical to the aa sequence of a heavy chain or light chain of FIG. 9, wherein the TFcBA has the desired biological characteristic(s).

TFcBAs may also comprise more than 2 binding sites, in which case, the heavy chain will comprise 1, 2, 3, 4 or more VH domains, which may be linked to the N- and/or C-terminus of any one of the following molecules: Fab-TFc-scFv; Fab-TFc-Fab; scFv-TFc-scFv; and scFv-TFc-Fab. The additional binding sites may be either Fabs or scFvs.

Biological Activities of TFcAs

In certain embodiments, a TFcA, e.g., a TFcBA, binding to one or more target proteins inhibits signal transduction mediated by the one or more target proteins. For example, an anti-c-Met+anti-EGFR TFcBA may inhibit signal transduction mediated through either or both of c-Met and EGFR. Inhibition of signal transduction may be evidenced, e.g., by inhibition of phosphorylation of EGFR and ERK. In certain embodiments, a TFcA inhibits phosphorylation of c-Met, EGFR and/or ERK by at least 30%, 40%, 50%, 60%, 70%, 80%, 85%, 90%, 95%, 98%, 99% or more, relative to phosphorylation in the absence of the TFcA, when determined, e.g., at the end of the experiment, e.g., as set forth in the Examples. Preferred TFcAs inhibit c-Met and/or EGFR signal transduction, e.g., measured by inhibition of phosphorylation of c-Met and EGFR, nearly completely, e.g., by at least 90%, 91%, 92%, 93%, 94%, 95%, 96%, 97%, 98%, 99% or 99.5%.

Although the biological characteristics described in this section are described mostly in the context of anti-c-Met/anti-EGFR TFcBAs, the description also applies to other TFcBAs, as well as monovalent TFcAs.

Inhibition of a) ligand mediated phosphorylation of c-Met, and b) ligand-mediated phosphorylation of EGFR can be demonstrated by the ability of a TFcBA to reproducibly decrease the level of phosphorylation of a) c-Met induced by an HGF family ligand, b) EGFR induced by an EGFR ligand, e.g., EGF, or c) ERK induced by a c-Met ligand or an EGFR ligand, each relative to the phosphorylation in control cells that are not contacted with the TFcBA. The cell which expresses c-Met and/or EGFR can be a naturally occurring cell or a cell of a cell line or can be recombinantly produced by introducing nucleic acid encoding c-Met and/or EGFR into a host cell. In certain embodiments, a TFcBA inhibits a HGF family ligand mediated phosphorylation of c-Met by at least about 5%, 10%, 20%, 30%, 40%, 50%, 60%, 70%, 80%, 85%, 90%, 91%, 92%, 93%, 94%, 95%, 96%, 97%, 98% or 99%, or more, as determined, for example, by ELISA, and calculated as set forth in the Examples. In certain embodiments, a TFcBA inhibits EGF-mediated phosphorylation of EGFR by at least about 5%, 10%, 20%, 30%, 40%, 50%, 60%, 70%, 80%, 85%, 90%, 91%, 92%, 93%, 94%, 95%, 96%, 97%, 98% or 99%, or more, as determined, for example, by ELISA, and calculated as set forth in the Examples. In certain embodiments, a TFcBA inhibits EGF and/or c-Met-mediated phosphorylation of ERK by at least about 5%, 10%, 20%, 30%, 40%, 50%, 60%, 70%, 80%, 85%, 90%, 91%, 92%, 93%, 94%, 95%, 96%, 97%, 98% or 99%, or more, as determined, for example, by ELISA, and calculated as set forth in the Examples.

TFcBAs may inhibit ligand induced phosphorylation of c-Met by at least 70% or 80%, ligand induced phosphorylation of EGFR by at least 85%, 90% or 95% and optionally ligand induced phosphorylation of ERK by at least 5% or 10%. TFcBAs may also inhibit ligand induced phosphorylation of c-Met by at least 85%, ligand induced phosphorylation of EGFR by at least 85% and optionally ligand induced phosphorylation of ERK by at least 5%. In certain embodiments, TFcBAs inhibit ligand induced phosphorylation of c-Met by at least 50% and ligand induced phosphorylation of EGFR by at least 90%, and optionally ligand induced phosphorylation of ERK by at least 5%.

TFcBAs may also be defined by the EC50 (i.e. the concentration of TFcBA at which 50% of maximum inhibition is obtained) of their inhibition of phosphorylation of one or more of c-Met, EGFR and ERK, which EC50s may be determined as further described herein. For example, TFcBAs disclosed herein may inhibit phosphorylation of c-Met with an EC50 of $10^{-8}$ M, $10^{-9}$ M, $10^{-10}$ M or lower. They may inhibit phosphorylation of EGFR with an EC50 of $10^{-8}$ M, $10^{-9}$ M, $10^{-10}$ M or lower. They may inhibit phosphorylation of ERK with an EC50 of $10^{-7}$ M, $10^{-8}$ M, $10^{-9}$ M, $10^{-10}$ M or lower. Some TFcBAs disclosed herein inhibit phosphorylation of c-Met by at least 80% or 85% with an EC50 of $10^{-8}$ M, $10^{-9}$ M, $10^{-10}$ M or lower; inhibit phosphorylation of EGFR by at least 80% or 85% with an EC50 of $10^{-8}$ M, $10^{-9}$ M, $10^{-10}$ M or lower; and optionally inhibit phosphorylation of ERK by at least 5% with an EC50 of $10^{-7}$ M, $10^{-8}$ M, $10^{-9}$ M, $10^{-10}$ M or lower. In some cases, essentially complete blockage of either or both of phosphorylation of c-Met and phosphorylation of EGFR will be obtainable with a TFcBA herein disclosed.

In certain embodiments, a solution comprising TFcAs at a concentration of 0.3, 0.5, 1, 2, 3, 4, 5, 6, 7, 8, 9, 10, 11, 12, 13, 14, 15 mg/ml or more (or ranges of concentrations between any of these two numbers) comprises more than 70%, 75%, 80%, 85%, 90%, 95%, 96%, 97%, 98% or 99% of TFcBAs in unaggregated form (referred to in this context as monomers) as determined e.g., by Size Exclusion Chromatography (SEC) e.g., following, a stability test as described below. The percentage of monomers may be determined in a solution after one of the following stability tests: a) incubation at 4° C. for 1, 2, 3, 4, 5, or 6 days, or 1, 2, 3 or more weeks; b) incubation at room temperature for 1, 2, 3, 4, 5, or 6 days, or 1, 2, 3 or more weeks; c) incubation at 37° C. for 1, 2, 3, 4, 5, or 6 days, or 1, 2, 3 or more weeks; d) 1, 2, 3, 4 or 5 cycles of freeze/thaw, and e) agitation, e.g., gentle agitation on the orbital shaker at room temperature, e.g., for 1, 2, 3, 4, 5 or more hours.

In certain embodiments, a TFcA exhibits a stability after 1, 2, 3, 4 or 5 days of incubation in serum at 37° C. of at least 70%, 75%, 80%, 85%, 90%, 95%, 96%, 97%, 98% or 99%, relative to its stability at day 0, where the stability of a protein is determined by, e.g., SEC or by measuring its ability to bind to one or more of its target antigens after incubation.

In certain embodiments, a TFcA has a melting temperature (Tm) as determined e.g., by Differential Scanning Fluorimetry (DSF) of at least 50° C., 55° C., 58° C. or 60° C., as described in the Examples.

TFcAs may have a combination of two or more of the characteristics set forth herein. For example, a TFcBA may inhibit ligand induced phosphorylation of c-Met by at least 70% and ligand induced phosphorylation of EGFR by at least 70%, and also exhibit one or more of the following characteristics: (i) a Tm, as determined by DSF, of at least 55 or 60° C.; and (ii) be at least 70%, 80% or 90% monomeric in PBS at 10 mg/mL after 5 or more days at room temperature, 2 weeks at 4° C., one or more cycles of freeze-thaw or gentle agitation. In certain embodiments, TFcBAs have a Tm of at least 60° C. and stability at room temperature, 4° C. or 37° C. of at least 90% (concentration of monomer after incubation under these conditions relative to the initial concentration of monomer).

In certain embodiments, a TFcA composition comprises one or more of the following characteristics: 1) at least 50%, 60%, 70%, 80%, 90% or more of the proteins are visible on SDS PAGE after purification on protein A; 2) at least 50%, 60%, 70%, 80%, 90% or more of observed species on SDS-PAGE gels are of the correct molecular weight; 3) the thermal stability profile, as measured by Differential Scanning Fluorimetry, does not show molten globular behavior; 4) does not comprise more than 50%, 60%, 70%, 80%, 90%, 95%, 98% or 99% or more monomer as visualized by SEC; and 5) inhibits more than 95% of EGF receptor signaling activated by addition of exogenous EGF ligand, as measured by pEGFR inhibition.

Standard assays may be used for determining the biological activity and characteristics of TFcAs, such as TFcBAs. Exemplary assays are provided in the Examples.

Nucleic acids, expression vectors and host cells

Provided herein are nucleic acids, e.g., DNA and RNA, encoding the polypeptides described herein. Exemplary nucleotide sequences provided herein are those encoding the aa sequences set forth in the Figures. In certain embodiments, a nucleotide sequence encoding a heavy or light chain of a TFcA is linked to a sequence that enhances or promotes the expression of the nucleotide sequence in a cell to produce a protein. Such nucleic acids may be encompassed within a vector, e.g., an expression vector.

For the purposes of being secreted, a heavy and/or light chain of a TFcA preferably comprises a signal sequence, which is normally cut off after secretion to provide a mature polypeptide. The following signal sequences may be used: MGFGLSWLFLVAILKGVQC (SEQ ID NO:241): for use, e.g., in expressing heavy chains; and MGTPAQLLFLLLLWLPDTTG (SEQ ID NO:243) for use, e.g., in expressing light chains.

An exemplary nucleotide sequence encoding SEQ ID NO:241 is atgggcttcggactgtcgtggcttttctggtggcgattcttaagggggtccagtgc (SEQ ID NO:240) and an exemplary nucleotide sequence encoding SEQ ID NO:243 is atgggcacccccgcacagctcttgttcttgctgcttctttggctccctgacacaactggt (SEQ ID NO:242).

Nucleic acids, e.g., DNA, that comprise a nucleotide sequence that is at least about 70%, 75%, 80%, 90%, 95%, 97%, 98% or 99% identical to a nucleotide sequence encoding a polypeptide described herein or a nucleotide sequence set forth herein, and which encode a heavy and or light chain of a TFcA, or portion thereof, as further described herein, are also encompassed herein. Such nucleotide sequences may encode a protein set forth herein or may encode a protein that is at least 70%, 75%, 80%, 85%, 90%, 95%, 97%, 98% or 99% identical or similar to a protein set forth herein or a portion thereof (e.g., a domain), such as an aa sequence set forth in any one of the Figures.

Also encompassed herein are cells, e.g., host cells, comprising a nucleic acid or a vector provided herein.

The TFcAs described herein may be produced by recombinant means. Methods for recombinant production are widely known in the state of the art and comprise protein expression in prokaryotic and eukaryotic cells with subsequent isolation of the antibody and usually purification to a pharmaceutically acceptable purity. For the expression of the TFcAs in a host cell, nucleic acids encoding the respective polypeptides, e.g., light and heavy chains, are inserted into expression vectors by standard methods. Expression is performed in appropriate prokaryotic or eukaryotic host cells like CHO cells, NSO cells, SP2/0 cells, HEK293 cells, COS cells, PER.C6 cells, yeast, or *E. coli* cells, and the TFcA is recovered from the cells (supernatant or cells after lysis). General methods for recombinant production of antibodies are well-known in the state of the art and described, for example, in the review articles of Makrides, S. C., Protein Expr. Purif 17 183-202 (1999); Geisse, S., et al, Protein Expr. Purif. 8 271-282 (1996); Kaufman, R. J., Mol. Biotechnol. 16 151-161 (2000); Werner, R.G., Drug Res. 48 870-880 (1998).

The TFcAs may be suitably separated from the culture medium by conventional immunoglobulin purification procedures such as, for example, protein A-Sepharose, hydroxylapatite chromatography, gel electrophoresis, dialysis, or affinity chromatography. DNA and RNA encoding the TFcAs are readily isolated and sequenced using conventional procedures. The hybridoma cells can serve as a source of such DNA and RNA. Once isolated, the DNA may be inserted into expression vectors, which are then transfected into host cells such as HEK 293 cells, CHO cells, or myeloma cells that do not otherwise produce immunoglobulin protein, to obtain the synthesis of recombinant TFcAs in the host cells.

Aa sequence variants (or mutants) of the TFcAs may be prepared by introducing appropriate nucleotide changes into the TFcA DNA, or by nucleotide synthesis.

"Host cell" denotes any kind of cellular system which can be engineered to generate the TFcAs described herein. In one embodiment, HEK293 cells and CHO cells are used as host cells. Expression in NSO cells is described by, e.g., Barnes, L. M., et al, Cytotechnology 32 109-123 (2000); Barnes, L. M., et al., Biotech. Bioeng. 73 261-270 (2001). Transient expression is described by, e.g., Durocher, Y., et al., Nucl. Acids. Res. 30 E9 (2002). Cloning of variable domains is described by Orlandi, R., et al., Proc. Natl. Acad. Sci. USA 86 3833-3837 (1989); Carter, P., et al., Proc. Natl. Acad. Sci. USA 89 4285-4289 (1992); and Norderhaug, L., et al., J. Immunol. Methods 204 77-87 (1997). An exemplary transient expression system (HEK 293) is described by Schlaeger, E.-J., and Christensen, K., in Cytotechnology 30 71-83 (1999) and by Schlaeger, E.-J., in J. Immunol. Methods 194 191-199 (1996).

The control sequences that are suitable for prokaryotes, for example, include a promoter, optionally an operator sequence, and a ribosome binding site. Eukaryotic cells are known to utilize promoters, enhancers and polyadenylation signals.

A nucleic acid is "operably linked" when it is placed in a functional relationship with another nucleic acid sequence. For example, DNA for a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites. If such sites do not exist, the synthetic oligonucleotide adaptors or linkers are used in accordance with conventional practice.

Purification of TFcAs may be performed in order to eliminate cellular components or other contaminants, e.g. other cellular nucleic acids or proteins, by standard techniques, including alkaline/SDS treatment, CsCl banding, column chromatography, agarose gel electrophoresis, and others well known in the art. See Ausubel, F., et al., ed. Current Protocols in Molecular Biology, Greene Publishing and Wiley Interscience, New York (1987). Different methods are well established and widespread used for protein purification, such as affinity chromatography with microbial proteins (e.g. protein A or protein G affinity chromatography), ion exchange chromatography (e.g. cation exchange (carboxylmethyl resins), anion exchange (amino ethyl resins) and mixed-mode exchange), thiophilic adsorption (e.g. with beta-mercaptoethanol and other SH ligands), hydrophobic interaction or aromatic adsorption chromatography (e.g. with phenyl-sepharose, aza-arenophilic resins, or m-aminophenylboronic acid), metal chelate affinity chromatography (e.g. with Ni(II)- and Cu(II)-affinity material), size exclusion chromatography, and electrophoretical methods (such as gel electrophoresis, capillary electrophoresis) (Vijayalakshmi, M. A. Appl. Biochem. Biotech. 75 93-102 (1998)).

Methods of Using TFcAs

Provided herein are methods of using TFcAs, e.g., TFcBAs. The TFcBAs can be used for treating a disease or disorder associated with receptor dependent signaling, including a variety of cancers.

In one embodiment, a method is provided for inhibiting proliferation of a tumor cell expressing the targets of a TFcA, e.g., c-Met, ErbB2, ErbB3, ErbB4, IGF1R, IGF2R, Insulin receptor, RON, EGFR, VEGFR1, VEGFR2, TNFR, FGFR1-4, PDGFR (alpha and beta), c-Kit, EPCAM and/or EphA2. A method may comprise contacting the tumor cell with a TFcA such that proliferation of the tumor cell is inhibited, slowed down, or stopped or such that the tumor cell dies.

Provided herein are methods for treating a disease or disorder associated with the signaling pathway of the targets of a TFcBA, e.g., c-Met, ErbB2, ErbB3, ErbB4, IGF1R, IGF2R, Insulin receptor, RON, EGFR, VEGFR1, VEGFR2, TNFR, FGFR1-4, PDGFR (alpha and beta), c-Kit, EPCAM and/or EphA2, by administering to a patient a TFcBA in an amount effective to treat the disease or disorder. Suitable diseases or disorders include, for example, a variety of cancers including, but not limited to breast cancer and those set forth below. In one embodiment, a method for treating a subject having a proliferative disease, such as cancer, comprises administering to a subject in need thereof a therapeutically effective amount of one or more TFcA.

Also provided is a method for (or a TFcA, e.g., a medicament for) treating a tumor expressing the target(s) of a TFcA, e.g., a TFcBA, e.g., c-Met, ErbB2, ErbB3, ErbB4, IGF1R, IGF2R, Insulin receptor, RON, VEGFR1, VEGFR2, TNFR, FGFR1-4, PDGFR (alpha and beta), c-Kit, EPCAM, EphA2 and/or EGFR, in a patient, the method comprising administering an amount of a TFcA effective to slow down or stop tumor growth, to stop or to shrink a tumor or to slow or stop tumor invasivness or tumor metastasis). A tumor expressing c-Met, ErbB2, ErbB3, ErbB4, IGF1R, IGF2R, Insulin receptor, RON, VEGFR1, VEGFR2, TNFR, FGFR1-4, PDGFR (alpha and beta), c-Kit, EPCAM, EphA2 and/or EGFR may be treated including tumors of the following cancers: gastric, esophageal, colorectal, non-small cell lung, pancreatic, prostate, renal, and thyroid cancers, hepatocellular carcinoma, glioma/glioblastoma, and breast cancer (basal/triple-negative and HER2+).

A method of treating a tumor or a subject having a tumor can further comprise administering a second anti-cancer agent in combination with the TFcA. Thus novel compositions are contemplated comprising a TFcA, together with a second anti-cancer agent, typically a biologic agent together with at least one pharmaceutically acceptable carrier or excipient.

Also provided are kits comprising one or more TFcAs. The kits may include a label indicating the intended use of the contents of the kit and optionally including instructions for use of the kit in treating a disease or disorder associated with a target of a TFcA dependent signaling, e.g., EGFR and/or c-Met dependent signaling. The term label includes any writing, marketing materials or recorded material supplied on or with the kit, or which otherwise accompanies the kit.

Pharmaceutical Compositions

In another aspect, a composition, e.g., a pharmaceutical composition, is provided for treatment of a tumor in a patient, as well as methods of use of each such composition to treat a tumor in a patient. The compositions provided herein contain one or more of the antibodies, e.g., TFcAs, disclosed herein, formulated together with a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the antibody may be coated in a material to protect it from the action of acids and other natural conditions that may inactivate proteins.

Pharmaceutical compositions may be administered alone or in combination therapy, i.e., combined with other agents. For example, the combination therapy can include an antibody of the present disclosure with at least one additional therapeutic agent, such as an anti-cancer agent. Pharmaceutical compositions can also be administered in conjunction with another anti-cancer treatment modality, such as radiation therapy and/or surgery.

A composition of the present disclosure can be administered by a variety of methods known in the art. As will be appreciated by the skilled artisan, the route and/or mode of administration will vary depending upon the desired results.

To administer a composition provided herein by certain routes of administration, it may be necessary or desirable to coat the antibody with, or co-administer the antibody with, a material to prevent its inactivation. For example, the antibody may be administered to a patient in an appropriate carrier, for example, in liposomes, or a diluent. Pharmaceutically acceptable diluents include saline and aqueous buffer solutions. Liposomes include water-in-oil-in-water CGF emulsions as well as conventional liposomes.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any excipient, diluent or agent is incompatible with the active compound, use thereof in the pharmaceutical compositions provided herein is contemplated. Supplementary active compounds (e.g., additional anti-cancer agents) can also be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. Saline solutions and aqueous dextrose and glycerol solutions can be employed as liquid carriers, particularly for injectable solutions. The composition, if desired, can also contain minor amounts of wetting or solubility enhancing agents, stabilizers, preservatives, or pH buffering agents. In many cases, it will be useful to include isotonic agents, for example, sodium chloride, sugars, polyalcohols such as mannitol, sorbitol, glycerol, propylene glycol, and liquid polyethylene glycol in the composition. Prolonged absorption of the injectable compositions can be brought about by including in the composition an agent that delays absorption, for example, monostearate salts and gelatin.

EXAMPLES

The following examples should not be construed as limiting the scope of this disclosure.

Throughout the examples, the following materials and methods are used unless otherwise stated. In general, the practice of the techniques of the present disclosure employs, unless otherwise indicated, conventional techniques of chemistry, molecular biology, recombinant DNA technology, immunology (especially, e.g., antibody technology), pharmacology, pharmacy, and standard techniques in polypeptide preparation.

Example 1

Identification of Stable Tandem Fc Structures

This example describes the identification of stable multivalent Ab formats. In this Example and in Example 2, protein constructs were used that do not contain binding sites. Several formats were compared, and each of these formats was derived from either one of the following two tandem Fc constructs:

1) TFc "23" or "IgG1 TFc," which comprises an IgG1 TFc comprising an IgG1 hinge; an IgG1CH2 domain comprising the substitution N297Q; an IgG1 CH3 domain comprising the substitutions T366S/L368A/Y407V; a TFc linker consisting of $(G4S)_8$ (SEQ ID NO: 491), an IgG1 hinge that does not comprise the upper hinge; an IgG1 CH2 domain comprising the substitution N297Q; and an IgG1 CH3 domain comprising the substitution T366W. This construct comprises the aa sequence set forth as SEQ ID NO:293 (see FIG. 11); and
2) TFc "39" or "IgG1/IgG4 TFc," which comprises an IgG1/IgG4 tandem TFc comprising a hybrid IgG1/IgG4 hinge comprising an IgG1 upper hinge and a core and lower IgG4 hinge; an IgG4 CH2 domain comprising the substitution T299K; an IgG1 CH3 domain comprising the substitutions T366S/L368A/Y407V; a TFc linker consisting of $(G4S)_8$ (SEQ ID NO: 491); an IgG4 hinge that does not comprise the upper hinge; an IgG4 CH2 domain comprising the substitution T299K; and an IgG1 CH3 domain comprising the substitution T366W. This construct comprises the aa sequence set forth as SEQ ID NO:319 (see FIG. 11).

Six modified versions of TFc 23 and 39 were created, and these are listed in Table 15. Briefly, a first modification was the addition of a disulfide bond in the viscinity of the knob or hole (TFc 23A). Another modification was the change of the knob hole of 23A for a smaller knob/hole (TFc 23B). Another modification introduced 1 or 2 cysteines in the upper hinge of the first hinge, to create disulfide bridges within the TFc (TFc 23 D and C, respectively). Another modification introduced a C-terminal cysteine in the CH3 domain (TFc 23E). Another modification in the TFc consisted of reducing the length of the TFc linker by 20 aas (TFc 23F, also referred to as "23G"). The aa sequences of these newly modified TFcs (shown in Table 15) are the same as those set forth in FIGS. 6 and 7, except that the TFcs used in this example did not comprise part of the upper hinge, i.e., aas EPKSC (SEQ ID NO: 424), and comprised a signal peptide. The nucleotide and aa sequences of these TFcs are shown in FIG. 11, and the identity of each of the domains or elements of the TFcs is set forth in Tables 12 and13, with the only difference that the first hinge does not comprise EPKSC (SEQ ID NO: 424) atits N-terminus.

TABLE 15

TFcs ("$(G_4S)_8$" and "$(G_4S)_4$" disclosed as SEQ ID NOS 491 and 496, respectively)

| Name of TFc | Modifications to TFc | TFc linker | SEQ ID NO of TFc |
|---|---|---|---|
| 23 | T366S/L368A/Y407V::T366W | $(G_4S)_8$ | SEQ ID NO: 293 |
| 39 | | | SEQ ID NO: 319 |
| 23A | Y349C/T366S/L368A/ | $(G_4S)_8$ | SEQ ID NO: 295 |
| 39A | Y407V:: S354C/T366W | | SEQ ID NO: 321 |
| 23B | Y407T::T366Y | $(G_4S)_8$ | SEQ ID NO: 297 |
| 39B | | | SEQ ID NO: 323 |
| 23C | H224C/T225C/T366S/L368A/ | $(G_4S)_8$ | SEQ ID NO: 299 |
| 39C | Y407V::T366W | | SEQ ID NO: 325 |
| 23D | T223C/T366S/L368A/ | $(G_4S)_8$ | SEQ ID NO: 301 |
| 39D | Y407V::T366W | | SEQ ID NO: 327 |
| 23E | T366S/L368A/Y407V/C-term | $(G_4S)_8$ | SEQ ID NO: 303 |
| 39E | Cysteine::T366W/C-term Cysteine | | SEQ ID NO: 329 |
| 23G* | T366S/L368A/Y407V::T366W | $(G_4S)_4$ | SEQ ID NO: 305 |

*23G contains the same TFc as that referred to elsewhere as "23F."

The different nucleic acids (having SEQ ID NOs: 292, 294, 296, 298, 300, 302, 304, 318, 320, 322, 324, 326, or 328) were transiently transfected into FREESTYLE™ 293F cells (Invitrogen) and purified with a one step protein A purification essentially as follows. The nucleic acids encoding the proteins are cloned as single proteins into the expression plasmid using standard recombinant DNA techniques. An expression vector employed is pCEP4 (Invitrogen). Expression plasmids are transfected using Polyethylene imine (2.5 μg/ml culture) and DNA (1 μg/ml cell culture). Transfected cells are incubated at 37° C., 5% $CO_2$ for six days and then harvested. All proteins are purified using protein A affinity protocol, in accordance with manufacturer's instructions. The protein A affinity step is used to selectively and efficiently bind the fusion proteins out of harvested cell culture fluids (HCCF). This removes >95% of product impurities in a single step with high yields and high throughput. The portion of desired molecular form for fusion proteins after this step was in the range of 60 to 98 percent. MABSELECT™ from GE is used as the Protein A affinity resin. The purified material was concentrated and dialyzed into PBS.

A) Percentage Monomers

TFc solutions were subjected to the determination of the percentage monomer present by Size Exclusion Chromatography (SEC) either in the initial solution or after incubation at 4° C., 37° C., after freeze-thaw or after gentle agitation on the orbital shaker at room temperature. SEC was performed essentially as follows. SEC is performed using Agilent 1100 Series HPLC system. 50 μg of each molecule is injected on a TSK Super SW3000 gel column (Tosoh Biosciences, P/N 18675). PBS is used as running and equilibration buffer at a flow rate of 0.35 ml/min.

Table 16 provides the percentage monomer of exemplary TFcs in initial solutions at the indicated concentrations.

TABLE 16

Percentage monomer of exemplary TFcs

| Protein | Concentration | % monomer at 0 days |
|---|---|---|
| 23G | 3 mg/ml | 87.9 |
| 23 | 5 mg/ml | 71.4 |
| 39C | 0.5 mg/ml | 39.5 |
| 39D | 0.5 mg/ml | 50.9 |
| 39 | 12.5 mg/ml | 66.4 |

In another experiment, the percentage monomer was determined in the initial solution after concentration of the molecules essentially as described above. Table 17 provides the results.

TABLE 17

Percentage monomer in initial solution after concentration

| | mg/ml | % monomer |
|---|---|---|
| 23A | 5.2 | 67% |
| 23D | 10.0 | 78% |
| 23E | 16.8 | 74% |

A compilation of Tables 16 and 17 is shown below in Table 18

TABLE 18

Percentage monomer of exemplary TFcs

| Protein | Initial Concentration (mg/ml) | % monomer at initial concentration | Second concentration (mg/ml) | % monomer at second concentration |
|---|---|---|---|---|
| 23 | 5.0 | 71.4% | | |
| 23A | 0.23 | 83.7% | 5.2 | 67% |
| 23B | 1.22 | 58.2% | | |
| 23C | 5.0 | 74.6% | | |
| 23D | 0.32 | 82.0% | 10.0 | 78% |
| 23E | 0.74 | 77.5% | 16.8 | 74% |
| 23G | 0.27 | 87.9% | | |
| 39 | 12.5 | 66.4% | | |
| 39A | n/d | n/d | | |
| 39B | 0.95 | 55.0% | | |
| 39C | 0.5 | 74.6% | | |
| 39D | 0.5 | 50.9% | | |
| 39E | 0.95 | 55.0% | | |
| 39G | 0.27 | 74.8% | | |

Table 19 shows the percentage monomer of TFcs 39E and 23C in solution as determined after having been exposed to various conditions.

TABLE 19

| Percentage monomer of 39E and 23C after exposure to various conditions | | |
|---|---|---|
| Condition | 39E 12.9 mg/ml | 23C 5 mg/ml |
| 0 days | 89.7% | 74.6% |
| 4° C., 2 weeks | 90.6% | 82.5% |
| Room temp., 10 days | 90.3% | 83.0% |
| 37° C., 2 weeks | 88.1% | — |
| Freeze/thaw | 90.9% | 85.0% |
| Agitate | 90.7% | — |

The results indicate that the TFcs have very different stabilities in the solution at day 0 and under the various conditions tested. 39E and 23G appear to have better stability than others.

B) SDS PAGE Analysis

Figure 8:
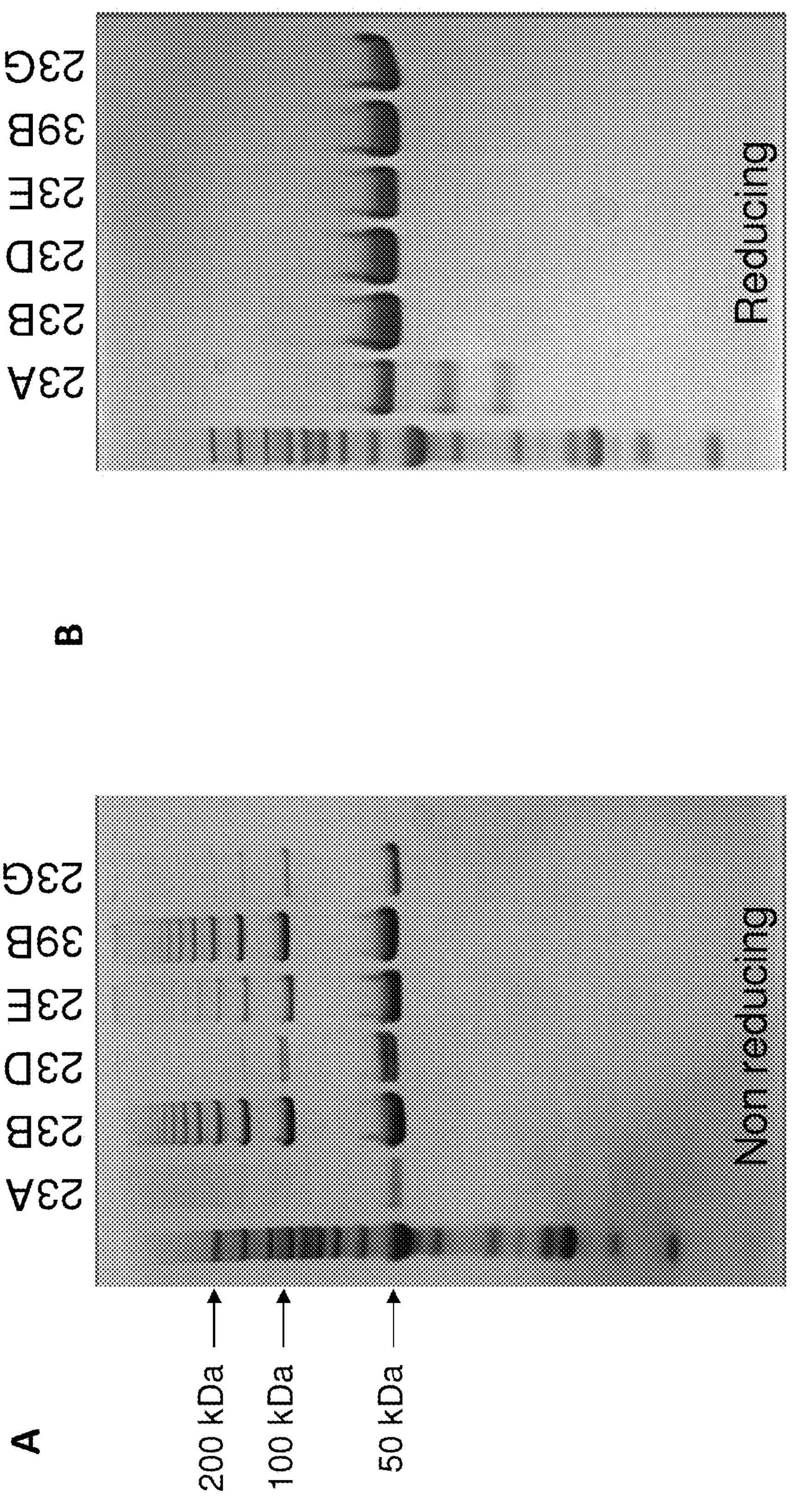
FIG. 8: Samples of TFcs 23A, 23B, 23D, 23E, 39B and 39G separated on a 4-12% SDS-PAGE gel under A) non reducing or B) reducing conditions. Molecular weights (in kilodaltons) of the molecular weight markers (Biorad Precision Plus Marker) of lane 1 are shown on the left of the gel.

The TFcs were run on a 4-12% SDS-PAGE gel in non-denaturing conditions and visualized by Coomassie stain. The results are shown in FIG. 8.

Example 2

Synthesis of Second Generation TFcs

To further improve the characteristics of the TFc molecules, further modifications were made to them. The modifications included (i) varying the length of the TFc linker ("23E (35L)", "39E (35L)", "23E (30L)", "39E (30L)", "23E (25L)" and "39E (25L)"); (ii) changing the combination of AEMs and C-terminal cysteine modifications within each of the two CH3 domains ("23E (35L) Inverted" and ("39E (35L) Inverted"); and (iii) changing the mutations that enhance CH3 association ("231", "391", "23J" and "39J"). These modifications are summarized in Table 20. The aa sequences of these newly modified TFcs are set forth in FIG. 11 and the identity of each of their domains or elements is set forth in Tables 12 and 13.

TABLE 20

Second generation TFcs ("KSCDKT," "GEC," "$(G_4S)_7$," "$(G_4S)_6$," "$(G_4S)_5$" and "$(G_4S)_8$" disclosed as SEQ ID NOS 167, 168, 499, 498, 497 and 491, respectively)

| Name of TFcBA | Modifications to TFc | TFc linker | SEQ ID NO of TFc |
|---|---|---|---|
| 23E (35L) | T366S/L368A/Y407V/C-term Cysteine | $(G_4S)_7$ | SEQ ID NO: 185 |
| 39E (35L) | KSCDKT::T366W/C-term Cysteine GEC | | SEQ ID NO: 211 |
| 23E (35L) | T366S/L368A/Y407V/C-term Cysteine | $(G_4S)_7$ | SEQ ID NO: 187 |
| Inverted 39E (35L) Inverted | GEC::T366W/C-term Cysteine KSCDKT | | SEQ ID NO: 213 |
| 23E (30L) | T366S/L368A/Y407V/C-term Cysteine | $(G_4S)_6$ | SEQ ID NO: 189 |
| 39E (30L) | KSCDKT::T366W/C-term Cysteine GEC | | SEQ ID NO: 215 |
| 23E (25L) | T366S/L368A/Y407V/C-term Cysteine | $(G_4S)_5$ | SEQ ID NO: 191 |
| 39E (25L) | KSCDKT::T366W/C-term Cysteine GEC | | SEQ ID NO: 217 |
| 23I | S364H/F405A::Y349T/T394F | $(G_4S)_8$ | SEQ ID NO: 193 |
| 39I | | | SEQ ID NO: 219 |
| 23J | K370D/K392D/K409D::E356K/E357K/D399K | $(G_4S)_8$ | SEQ ID NO: 195 |
| 23J | | | SEQ ID NO: 221 |

The second generation TFcs were expressed and purified essentially as described in Example 1.

A) Percentage Monomers

TFc solutions were subjected to the determination of the percentage monomer present by SEC either in the initial solution or after 7 days at 4° C. SEC was performed essentially as described in Example 1.

Table 21 provides the percentage monomer of exemplary second generation TFcs in initial solutions and after 7 days at 4° C.

TABLE 21

Percentage monomer of exemplary TFcs ("$(G_4S)2$" disclosed as SEQ ID NO: 494)

| | | Day 1 | Day 7 |
|---|---|---|---|
| Fc1 | 23E/25L | 74.8% | |
| Fc2 | 23E/35L | Not measured | 77.9% |
| Fc3 | 39E/30L | 80.2% | |
| Fc4 | 39E/35L | Not measured | 78.9% |
| Fc5 | 39E/35L inv | 79.3% | |
| Fc6 | 23E/30L | 80.2% | |
| Fc7 | 23E/35L inv | 79.1% | |
| Fc8 | 39E/25L | 78.1% | |
| Original IgG1 Fc | 23E/40L | 78.8% | |
| Original IgG1/4 Fc | 39E/40L | 88.3% | |

The results indicate that a 40 aa linker, e.g., in molecules 23E and 39E, results in a more stable TFc than a shorter linker.

Example 3

Exemplary Anti-c-Met/Anti-EGFR TFcBAs

A) Exemplary Anti-c-Met Binding Sites

A TFcBA may comprise an anti-c-Met binding site comprising or consisting of that of the humanized 5D5 Ab (U.S. Pat. No. 7,476,724). The heavy chain may comprise the following Fab domain or VH domain thereof:

1) Without signal peptide:

EVQLVESGGGLVQPGGSLRLSCAASGYTFTSYWLHWVRQAPGKGLEWVGM

IDPSNSDTRFNPNFKDRFTISADTSKNTAYLQMNSLRAEDTAVYYCARYG

SYVSPLDYWGQGTLVTVSSASTKGPSVFPLAPSSKSTSGGTAALGCLVKD

-continued

YFPEPVTVSWNSGALTSGVHTFPAVLQSSGLYSLSSVVTVPSSSLGTQTY

ICNVNHKPSNTKVDKKV (SEQ ID NO: 223; the CDRs are underlined with a dotted line, and the CH1 domain is underlined)

2) Including the exemplary signal peptide consisting of SEQ ID NO: 241 (underlined)

MGFGLSWLFLVAILKGVQCEVQLVESGGGLVQPGGSLRLSCAASGYTFTS
YWLHWVRQAPGKGLEWVGMIDPSNSDTRFNPNFKDRFTISADTSKNTAYL
QMNSLRAEDTAVYYCARYGSYVSPLDYWGQGTLVTVSSASTKGPSVFPLA
PSSKSTSGGTAALGCLVKDYFPEPVTVSWNSGALTSGVHTFPAVLQSSGL
YSLSSVVTVPSSSLGTQTYICNVNHKPSNTKVDKKV (SEQ ID NO: 245; the signal peptide is underlined and boldface, the CDRs are underlined with a dotted line, and the CH1 domain is underlined)

The light chain may comprise the following Fab domain or VH domain thereof:

1) Without signal peptide:

DIQMTQSPSSLSASVGDRVTITCKSSQSLLYTSSQKNYLAWYQQKPGKAP
KLLIYWASTRESGVPSRFSGSGSGTDFTLTISSLQPEDFATYYCQQYYAY
PWTFGQGTKVEIKRTVAAPSVFIFPPSDEQLKSGTASVVCLLNNFYPREA
KVQWKVDNALQSGNSQESVTEQDSKDSTYSLSSTLTLSKADYEKHKVYAC
EVTHQGLSSPVTKSFNRGEC (SEQ ID NO: 231; the CDRs are underlined with a dotted line, and the CL domain is underlined)

2) Including the exemplary signal peptide consisting of SEQ ID NO: 243:

MGTPAQLLFLLLLWLPDTTGDIQMTQSPSSLSASVGDRVTITCKSSQSLL
YTSSQKNYLAWYQQKPGKAPKLLIYWASTRESGVPSRFSGSGSGTDFTLT
ISSLQPEDFATYYCQQYYAYPWTFGQGTKVEIKRTVAAPSVFIFPPSDEQ
LKSGTASVVCLLNNFYPREAKVQWKVDNALQSGNSQESVTEQDSKDSTYS
LSSTLTLSKADYEKHKVYACEVTHQGLSSPVTKSFNRGEC (SEQ ID NO: 247; the signal peptide is underlined and boldface, the CDRs are underlined with a dotted line, and the CL domain is underlined)

A TFcBA may also comprise an anti-c-Met binding site comprising or consisting of the following heavy and light chain portions, and referred to herein as "anti-c-Met binding site 2." The heavy chain may comprise the following Fab domain or VH domain thereof:

1) Without signal peptide:

QVQLVQSGAEVKKPGASVKVSCKASGYIFTAYTMHWVRQAPGQGLEWMGW
IKPNNGLANYAQKFQGRVTMTRDTSISTAYMELSRLRSDDTAVYYCARSE
ITTEFDYWGQGTLVTVSSASTKGPSVFPLAPSSKSTSGGTAALGCLVKDY
FPEPVTVSWNSGALTSGVHTFPAVLQSSGLYSLSSVVTVPSSSLGTQTYI
CNVNHKPSNTKVDKKV (SEQ ID NO: 287; the CDRs are underlined with a dotted line, and the CH1 domain is underlined)

2) Including the exemplary signal peptide consisting of SEQ ID NO: 241 (underlined):

MGFGLSWLFLVAILKGVQCQVQLVQSGAEVKKPGASVKVSCKASGYIFTA
YTMHWVRQAPGQGLEWMGWIKPNNGLANYAQKFQGRVTMTRDTSISTAYM
ELSRLRSDDTAVYYCARSEITTEFDYWGQGTLVTVSSASTKGPSVFPLAP
SSKSTSGGTAALGCLVKDYFPEPVTVSWNSGALTSGVHTFPAVLQSSGLY
SLSSVVTVPSSSLGTQTYICNVNHKPSNTKVDKKV (SEQ ID NO: 256; the signal peptide is underlined and boldface; the CDRs are underlined with a dotted line, and the CH1 domain is underlined)

The light chain may comprise the following Fab domain or VH domain thereof:

1) Without signal peptide:

DIVLTQSPDSLAVSLGERATINCKSSESVDSYANSFMHWYQQKPGQPPKL
LIYRASTRESGVPDRFSGSGSRTDFTLTISSLQAEDVAVYYCQQSKEDPL
TFGGGTKVEIKRTVAAPSVFIFPPSDEQLKSGTASVVCLLNNFYPREAKV
QWKVDNALQSGNSQESVTEQDSKDSTYSLSSTLTLSKADYEKHKVYACEV
THQGLSSPVTKSFNRGEC (SEQ ID NO: 289; the CDRs are underlined with a dotted line, and the CL domain is underlined)

2) Including the exemplary signal peptide consisting of SEQ ID NO: 243:

MGTPAQLLFLLLLWLPDTTGDIVLTQSPDSLAVSLGERATINCKSSESVD
SYANSFMHWYQQKPGQPPKLLIYRASTRESGVPDRFSGSGSRTDFTLTIS
SLQAEDVAVYYCQQSKEDPLTFGGGTKVEIKRTVAAPSVFIFPPSDEQLK
SGTASVVCLLNNFYPREAKVQWKVDNALQSGNSQESVTEQDSKDSTYSLS
STLTLSKADYEKHKVYACEVTHQGLSSPVTKSFNRGEC (SEQ ID NO: 345; the signal peptide is underlined and boldface; the CDRs are underlined with a dotted line, and the CL domain is underlined)

The aa sequences of the heavy chain of an exemplary mature TFcBA comprising in amino to carboxy terminal order: i) the Fab domain of the anti-c-Met binding site 5D5 (SEQ ID NO:223); ii) a TFc comprising AEM 1 and DiS 2 (SEQ ID NO:181); and iii) the panitumumab anti-EGFR scFv H1L1 having SEQ ID NO:233 (see below) is set forth as SEQ ID NO:235 (FIG. 9). The aa sequences of the heavy chain of an exemplary mature TFcBA comprising in amino to carboxy terminal order: i) the Fab domain of the anti-c-Met binding site 2 (SEQ ID NO:287), ii) a TFc comprising AEM 1 and DiS 2 (SEQ ID NO:181); and iii) the cetuximab anti-EGFR scFv H1L1 having SEQ ID NO:258 (see below) is set forth as SEQ ID NO:291 (FIG. 9). Generally, the exemplary anti-c-Met Fab heavy chain sequences provided here may be linked to any of the TFcs, or constructs comprising a TFc, disclosed herein. These proteins may be expressed with a signal sequence, which may be the signal sequence consisting of SEQ ID NO:241.

B) Exemplary Anti-EGFR scFvs

A TFcBA may comprise any of the following anti-EGFR scFvs (or variable domains or CDRs thereof):

1) Panitumumab (VECTIBIX) scFv

The aa sequence of the VH and VL domains of panitumumab is provided in U.S. Pat. No. 6,235,883, and are assembled into an scFv having the following aa sequence:

QVQLQESGPGLVKPSETLSLTCTVSGGSVSSGDYYWTWIRQSPGKGLEWI

GHIYYSGNTNYNPSLKSRLTISIDTSKTQFSLKLSSVTAADTAIYYCVRD

RVTGAFDIWGQGTMVTSS*ASTGGGGSGGGGSGGGGSGGGGS*DIQMTQSPS

SLSASVGDRVTITCQASQDISNYLNWYQQKPGKAPKLLIYDASNLETGVP

SRFSGSGSGTDFTFTISSLQPEDEATYFCQHFDHLPLAFGGGTKVEIKRT (SEQ ID NO:233; the scFv linker is in italics and the VH and VL CDRs are underlined with a dotted line)

2) 2224 scFv

The aa sequence of the VH and VL domains of Ab 2224 is provided in U.S. Patent Publication No 2010/0009390, and are assembled into an scFv having the following aa sequences:

EVQLVQSGAEVKKPGSSVKVSCKASGGTFSSYAIGWVRQAPGQGLEWMGG

IIPIFGIANYAQKFQGRVTITADESTSSAYMELSSLRSEDTAVYYCAREE

GPYCSSTSCYAAFDIWGQGTLVTVSS*ASTGGGGSGGGGSGGGGSGGGG*

*S*QSVLTQDPAVSVALGQTVKITCQGDSLRSYFASWYQQKPGQAPTLVMYA

RNDRPAGVPDRFSGSKSGTSASLAISGLQPEDEADYYCAAWDDSLNGYLF

GAGTKLTVL (SEQ ID NO:237; the scFv linker is in italics and the VH and VL CDRs are underlined with a dotted line)

3) Humanized cetuximab scFv

The variable regions of Cetuximab were humanized and used for constructing the following scFvs, wherein the CDRs are underlined with dotted lines, the scFv linker is italicized and aa modifications resulting from the humanization are in lower case letters:

3.1) cetuximab scFv H1 L1

(SEQ ID NO:258)

QVQLVESGGGVVQPGESLRLSCAvSGFSLTNYGVHWVRQAPGKGLEWVgV

IWSGGNTDYNTPFTSRFTISkDNSKNTvYLQMNSLRAEDTAVYYCARALT

YYDYEFAYWGQGTLVTVSS*ASTGGGGSGGGGSGGGGSGGGGS*dIVLTQSP

DFQSVTPGEKVITCRASQSIGTNIHWYQQKPDQSPKLLIKYASESISGVP

SRFSGSGSGTDFTLTINSLEAEDEATYYCQQNNNWPTTFGQGTKVEIKRT 3.2) cetuximab scfv H1 L2

(SEQ ID NO: 275)

QVQLVESGGGVVQPGESLRLSCAvSGFSLTNYGVHWVRQAPGKGLEWVgV

IWSGGNTDYNTPFTSRFTISkDNSKNTvYLQMNSLRAEDTAVYYCARALT

-continued

YYDYEFAYWGQGTLVTVSS*ASTGGGGSGGGGSGGGGSGGGGS*dIVLTQSP sslSVTPGEKVTfTCRASQSIGTNIHWYQQKPgQSPKLLIKYASESISGV PSRFSGSGSGTDFTLTINSvEAEDEATYYCQQNNNWPTTFGQGTKlEIKR

T 3.3) cetuximab scFv H2 L1

(SEQ ID NO: 277)

QVQLVESGGGVVQPGESLRiSCAvSGFSLTNYGVHWVRQAPGKGLEWlgV

IWSGGNTDYNTPFTSRlTISkDNSKsTvYfQMNSLRAEDTAVYYCARALT

YYDYEFAYWGQGTLVTVSS*ASTGGGGSGGGGSGGGGSGGGGS*dIVLTQSP

DFQSVTPGEKVTITCRASQSIGTNIHWYQQKPDQSPKLLIKYASESISGV

PSRFSGSGSGTDFTLTINSLEAEDEATYYCQQNNNWPTTFGQGTKVEIKR

T 3.4) cetuximab scFv H2 L2

(SEQ ID NO: 279)

QVQLVESGGGVVQPGESLRiSCAvSGFSLTNYGVHWVRQAPGKGLEWlgV

IWSGGNTDYNTPFTSRlTISkDNSKsTvYfQMNSLRAEDTAVYYCARALT

YYDYEFAYWGQGTLVTVSS*ASTGGGGSGGGGSGGGGSGGGGS*dIVLTQSP sslSVTPGEKVTfTCRASQSIGTNIHWYQQKPgQSPKLLIKYASESISGV PSRFSGSGSGTDFTLTINSvEAEDEATYYCQQNNNWPTTFGQGTKlEIKR

T

The VH and VL domains of the humanized cetuximab Abs may be used in any other format of Ab, e.g., an Ab having a naturally occurring structure comprising two heavy chains and two light chains.

The aa sequence of the heavy chain of an anti-c-Met/anti-EGFR TFcBA comprising i) the humanized 5D5 anti-c-Met VH domain (SEQ ID NO:223); ii) a TFc comprising AEM 1 and DiS 2 (SEQ ID NO:181); and iii) the panitumumab anti-EGFR scFv having SEQ ID NO:233 is set forth as SEQ ID NO:235 (FIG. 9). The aa sequences of the heavy chain of anti-c-Met/anti-EGFR TFcBAs comprising the same binding sites as those in SEQ ID NO:235, but comprising a different TFc are set forth in SEQ ID NOs: 343, 225, 227 and 229 (FIG. 9). The aa sequence of the heavy chain of an anti-c-Met/anti-EGFR TFcBA comprising i) the humanized 5D5 anti-c-Met VH domain (SEQ ID NO:223); ii) a TFc comprising AEM 1 and DiS 2 (SEQ ID NO:181); and iii) the 2224 anti-EGFR scFv having SEQ ID NO:237 is set forth as SEQ ID NO:239 (FIG. 9). The aa sequences of the heavy chain of an anti-c-Met/anti-EGFR TFcBA comprising i) the humanized 5D5 anti-c-Met VH domain (SEQ ID NO:223);

ii) a TFc comprising AEM 1 and DiS 2 (SEQ ID NO:181); and iii) a cetuximab anti-EGFR scFv consisting of SEQ ID NO:258, 275, 277 or 279 are set forth as SEQ ID NOs:260, 281, 283 and 285, respectively (FIG. 9). Generally any of the anti-EGFR scFvs disclosed herein, or their variable or CDR sequences, may be linked to any of the TFcs, or constructs comprising a TFc, disclosed herein.

Nucleotide sequences encoding the Fab domains, scFvs and TFcBAs are provided in FIG. 10.

Other exemplary anti-c-Met/anti-EGFR TFcBAs are set forth in Table 21, wherein each of the sequences may be connected to the adjacent sequence in amino to carboxy terminal order without intervening sequence.

TABLE 21

Exemplary TFcBAs

| Anti-c-Met heavy chain Fab | TFc | Connecting linker | Anti-EGFR scFv |
|---|---|---|---|
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Panitumumab (SEQ ID NO: 233) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | 2224 (SEQ ID NO: 237) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H1L1 (SEQ ID NO: 258) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H1L2 (SEQ ID NO: 275) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H2L1 (SEQ ID NO: 277) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H2L2 (SEQ ID NO: 279) |
| Binding site 2 (SEQ ID NO: 287 or 256) with light chain having SEQ ID NO: 289 or 345 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Panitumumab (SEQ ID NO: 233) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | 2224 (SEQ ID NO: 237) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H1L1 (SEQ ID NO: 258) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H1L2 (SEQ ID NO: 275) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H2L1 (SEQ ID NO: 277) |
| Humanized 5D5 (SEQ ID NO: 223 or 245) with light chain having SEQ ID NO: 231 or 247 | IgG1 TFc (SEQ ID NO: 171, 173, 175, 177, 179, 181, 183, 185, 187, 189, 191, 193 or 195) or IgG1/IgG4 hybrid TFc (SEQ ID NO: 197, 199, 201, 203, 205, 207, 209, 211, 213, 215, 217, 219 or 221) | (G4S)2 (SEQ ID NO: 494) | Cetuximab H2L2 (SEQ ID NO: 279) |

Example 4

Methods for Preparing and Characterizing TFcAs or TFcs

A) Protein Expression and Purification

Stable Transfection: Nucleic acids are transfected into CHO-K1 cells (Chinese hamster ovary; ATCC cat #CCL-61) using 1:1(:1) plasmid ratio, and are purified with a one step protein A purification method, e.g., according to the following protocol. The nucleic acids encoding the TFcAs or TFcs are cloned as single proteins into the expression plasmids using standard recombinant DNA techniques. An exemplary expression vector employed is pMP 10K (SELEXIS). Expression plasmids are linearized, purified using QIAquick purification kit (QIAGEN), and co-transfected into CHO-K1 cells using Lipofectamine LTX (Invitrogen). Transfected cells are recovered with Ham's F12 medium (Gibco) containing 10% FBS for 2 days without selection pressure, then with selection pressure for 4 days. After 4 days, they are changed into serum-free medium (Hyclone) containing glutamine with selection pressure. After a week, cells are checked for expression and scaled up to desired volume. All proteins are purified using protein A affinity protocol, carried out in accordance with manufacturer's instructions. The protein A affinity step is used to selectively and efficiently bind the TFcA or TFc proteins out of harvested cell culture fluids (HCCF). This removes >95% of product impurities in a single step with high yields and high throughput. The portion of desired molecular form for TFcAs or TFcs after this step is expected to be in the range of 60 to 98 percent. MABSELECT from GE is used as the Protein A affinity resin. The purified material is concentrated and dialyzed into PBS.

Transient transfection: Nucleic acids are transiently transfected into Freestyle 293F cells (Invitrogen) and purified with a one-step protein A purification essentially as follows. The nucleic acids encoding the proteins are cloned as single proteins into the expression plasmid using standard recombinant DNA techniques. An exemplary expression vector employed is pCEP4 (Life Technologies cat #R790-07). Expression plasmids are transfected using Polyethylene imine (2.5 μg/ml culture) and DNA (1 μg/ml cell culture). Transfected cells are incubated at 37° C., 5% $CO_2$ for six days and then harvested. All proteins are purified using protein A affinity protocol, in accordance with manufacturer's instructions. The protein A affinity step is used to selectively and efficiently bind the fusion proteins out of harvested cell culture fluids (HCCF). This removes >95% of product impurities in a single step with high yields and high throughput. MABSELECT from GE is used as the Protein A affinity resin. The purified material is concentrated and dialyzed into PBS.

B) SDS-PAGE Analysis

TFcBAs or TFcs are run on a 4-12% SDS-PAGE gel in non-denaturing conditions and visualized by Coomassie stain. This method may be used to determine whether a TFcA or TFc is properly formed or assembled.

C) Thermal Stability Measurement by DSF

The temperature at which a TFcA or TFc unfolds is determined by Differential Scanning Fluorimetry (DSF) essentially as follows. The DSF assay is performed in the IQ5 Real Time Detection System (Bio-Rad). 20 μl solutions of 15 uM TFcA or TFc, 1× SYPRO®Orange (Invitrogen Life Technologies), and 1×PBS are added to the wells of a 96 well plate. The plate is heated from 20° C. to 90° C. with a heating rate of 1° C./min. Data is transferred to GraphPad Prism for analysis.

D) pEGFR Inhibition

Inhibition of signal transduction through EGFR, e.g., ligand-induced signal transduction, by a TFcBA may be determined by measuring the effect of the particular TFcA on the phosphorylation of EGFR.

The following protocol is used to measure inhibition of EGFR. Cells (e.g. A431 cells (ATCC cat #CRL-1555) or NCI-H322M (National Cancer Institute)) are maintained in DMEM medium supplemented with 10% fetal bovine serum, Penicillin/Streptomycin and L-glutamine. For signaling experiments, $3.5\times10^4$ cells are plated in complete medium in 96-well tissue culture plates. The following day, complete medium is replaced with serum-free medium, and cells are incubated overnight at 37° C. Cells are pretreated for 2 hours with starting concentration of 300 nM and titrating 3-fold down for an 11 concentration dose for each TFcA or TFc, and then stimulated for 10 minutes with 8 nM EGF (Human recombinant EGF; Cat# AF-100-15; PeproTech, Inc.). Cells are washed with PBS and lysed in MPER buffer (cat #PI78505, VWR International) supplemented with protease and phosphatase inhibitors (COMPLETE Protease Inhibitor Cocktail Tablet® provided in EASY packs, cat #4693124001, Roche Diagnostics Corp; PhosSTOP Phosphatase Inhibitor Cocktail Tablets, cat #4906837001, Roche Diagnostics Corp). ELISAs for phospho-EGFR (pEGFR) are performed according to the manufacturer's protocols (pEGFR ELISA R&D kit (cat #: DYC1095-C)), with the exception that the capture Ab is EGFR Ab-11, Clone: 199.12 (Fisher Scientific Cat# MS396P1ABX). SuperSignal ELISA Pico Chemiluminescent Substrate (cat # PI37069, VWR International) is added and plates read on a PerkinElmer Envision plate reader. Luminescence values are plotted following normalization to the observed signal at the lowest concentration of TFcA or TFc. For data analyses, duplicate samples are averaged and error bars are used to represent the standard deviation between the two replicates. Inhibition curves and corresponding IC50 values are calculated using GraphPad Prism software (GraphPad Software, Inc.) via regression of the data to a 4 parameter logistic equation. To calculate percent inhibition, regressed values of maximal ('max') and minimum ('min') inhibitor potency can be utilized as follows:

curve_span=max−min;

baseline_span=max;

percent_inhibition=100*curve_span/baseline_span.

E) pERK Inhibition

Inhibition of signal transduction through c-Met and/or EGFR, e.g., ligand-induced signal transduction, by a TFcA may be determined by measuring the effect of the particular TFcA on the phosphorylation of ERK. The following protocol may be used to measure inhibition of pERK. Day 1: Actively midlog (about 80% confluency) growing cells (e.g., A431 cells) are split in DMEM (+10% FBS+L/glutamine+Pen/Strep) media. Approximately 35,000 cells are seeded/well in a 96 well-plate. Day 2: The media is changed from 10% FBS to serum-free media −0.5% FBS (+L/glutamine+Pen/Strep) media. Day 3: The inhibitors/antibodies are diluted into the appropriate volume of serum media. 100 μL of each inhibitor per concentration is added/well. The inhibitor is allowed to incubate at 37° C. for 2 hours. At the end of the 2 hour period, a final concentration of 8 nM EGF (Human recombinant EGF; Cat# AF-100-15; PeproTech, Inc.) is added to each inhibitor and each concentration of inhibitor for 10 min. The cells are washed 2× with cold PBS and later lysed in 40 μL/well of SureFire Lysis buffer (a 1:5 dilution of stock with water). The lysates are place in −80° C. usually within 5 min after lysis. Day 4: The protocol on performing the SureFire pERK 1/2 ELISA can be found in Perkin Elmer website (ALPHASCREEN PROTEIN A 10K PTS PerkinElmer Life Sciences, Inc. Cat #: 6760617M; TGR Surefire ERK1 384 Kit for 10,000 Ass; PerkinElmer Life Sciences, Inc. Cat #: TGRES10K). Essentially, the −80° C. lysate is thawed at room temperature. In the meantime, the reaction buffer is prepared in which the Activation Buffer and Reaction Buffer are mixed according to protocol. The Protein A detection kit reagents are added last to the reaction buffer prior to adding onto the 384 well plate. 4 μL of the thawed lysate is transferred onto a ProxiPlate 384, white shallow well plate (from Perkin Elmer; cat #6008280). After addition of the Protein A detection kit reagents, 7 μL of the final reaction buffer is transferred to each well (which already has 4 μL of the lysate in them). The plates are sealed tightly with aluminum sealer. The plate is spun down in an Eppendorf table top centrifuge at 1800 rpms for 1 minute. The plates are gently shaken at RT for 2 hours. The plates are then read in Perkin Elmer Envision Reader. Normalization of luminescence data and calculation of IC50 occurs as described for pEGFR.

Example 5

Protocols for Measurement of ELISA Plate-Based Antibody Binding

Binding of Bispecific Antibodies to Soluble cMet-Fc and EGFR-his

Reacti-bind plates (96 well) are coated with 50 μL of cMet-Fc (2 μg/mL in PBS), and incubated overnight at 4° C. Next day, the plates are washed with PBS-T (PBS+0.05% TWEEN-20®), blocked for 1 hour at room temperature with 100 μL of blocking buffer, and washed again with PBS-T. Plates are incubated with 50 μL of bispecific antibodies at room temperature for 2 hours, and then washed with PBS-T. Antibody concentrations start at 500 nM (in PBS-T), and include ten additional two-fold dilutions and one blank (PBS-T only). Plates are then incubated with 50 μL of EGFR-his (at 1 μg/ml in PBS-T for one hour at room temperature. The plates are washed with PBS-T and then incubated with anti-his-HRP antibody diluted 1:10,000 in PBS-T for 1 hour at room temperature, and washed again with PBS-T. The plates are incubated with 100 μL of TMB substrate for 5-10 minutes at room temperature and the reaction is stopped by adding 100 μL of Stop solution. The absorbance was measured at 450 nm, and the resulting data analyzed using GraphPad Prism.

Figure 15:
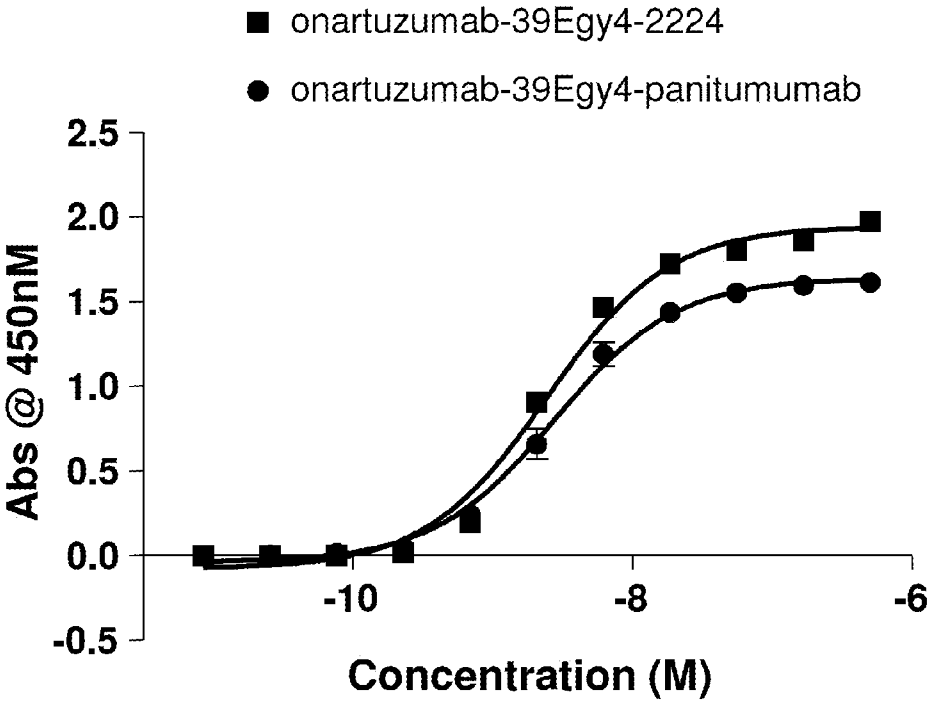
FIG. 15: A graph showing binding to cMet-Fc and EGFR-his of TFcBAs comprising the 39E glycoform 4 backbone, onartuzumab antibody and either 2224 or panitumumab antibody.

Exemplary results using TFcBAs in the method above can be seen in FIG. 15, which shows binding affinity of onartuzumab-39Egy-2224 (squares) and onartuzumab-39Egy-4-panitumumab (circles).

Example 6

Current Technologies for Asymmetric Fc-Domains Give Molecular Weight Heterogeneity Stable Transfection of CHO-K1 Cells Suspension-adapted CHO-K1 cells are grown in Hyclone Media supplemented with 8 mM L-glutamine to a density of 2 million/mL. On the day of transfection, the cells are resuspended in a serum-free media (Opti-MEM I) at a density of 80,000 cells/mL. The cells (500 μL) are then transfected with 1 μg of total DNA (including 10 ng of pNeo vector, an in-house vector carrying the geneticin selection marker) using 2.75 μL of Lipofectamine in a 24 well plate. After 3 hours, 1 mL of recovery media (HAMS-F12+10% FBS) is added, and the transfected cells allowed to recover for 48 hours. The cells are then expanded into a 96-well plate, and the selection marker geneticin was added to the recovery media at 500 μg/ml. After 4 more days, the media is replaced with serum free Hyclone media (supplemented with L-glutamine), and the transfected cells allowed to adapt. After a week, the selected cells form colonies, and the wells are tested for desired characteristics with western blots from the supernatant. The desired clones are expanded to a 24-well plate, then to a T-25 flask, and eventually to a shake flask. The desired clones are confirmed with SDS-PAGE, and scaled up to the desired volume. The cells are harvested by centrifugation (6000 g, 30 min) when the viability falls below 80%, and the supernatant filtered using a 0.22 μm filter.

Cells were transfected as described aboved and analyzed as follows. Results are shown in Table 22 below.

A) Western Blot Protocol

Figure 12A:
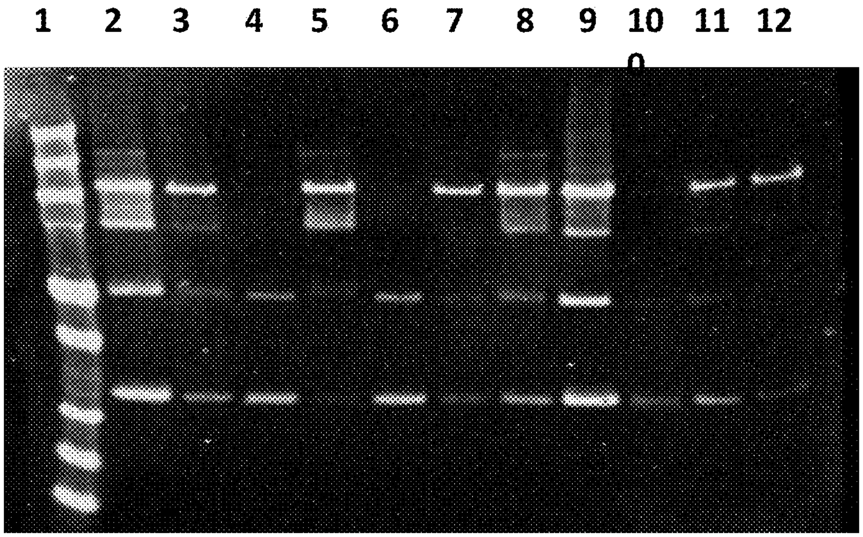
FIG. 12A: Selection of onartuzumab (OTZM) monoclonal cell line: Lane 1=size standards, Lanes 2-12; 2=OTZM line 1, 3=OTZM line 2, 4=OTZM line 3, 5=OTZM line 4, 6=OTZM line 5, 7=OTZM line 6, 8=OTZM line 7, 9=OTZM line 8, 10=OTZM line 9, 11=OTZM line 10, 12=OTZM line 11.
Figure 12B:
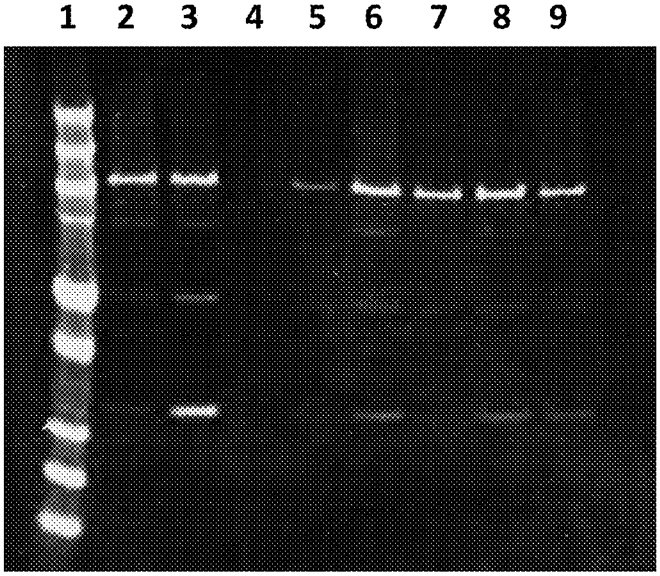
FIG. 12B: Selection of onartuzumab (OTZM) monoclonal cell line: Lane 1=size standards Lanes 2-9; 2=OTZM line 12, 3=OTZM line 13, 4=OTZM line 14, 5=OTZM line 15, 6=OTZM line 16, 7=OTZM line 17, 8=OTZM line 18, 9=OTZM line 19.

Cell supernatants expressing onartuzumab were run on a 4-12% SDS-PAGE gel in non-denaturing conditions. The proteins were transferred to nitrocellulose paper using the Invitrogen iBlot. The blot was washed with PBS-T and then incubated for one hour with anti-human-FC conjugated to IRD700. The blot was washed three times with PBS-T and then imaged using the L1-Cor Odyssey. The results are shown in FIG. 12.

B) Percentage Monomers

TFc solutions were subjected to the determination of the percentage monomer present by SEC in the initial solution. SEC was performed essentially as described in Example 1.

Table 22 provides the percentage monomer of exemplary second generation TFcs in initial solutions.

TABLE 22

Percentage monomer of exemplary onartuzumab clones

| Protein | High MW species | % monomer | Low MW species |
|---|---|---|---|
| Onartuzumab1 | | 78 | 22 |
| Onartuzumab2 | | 75 | 25 |
| Onartuzumab3 | | n/d | |
| Onartuzumab4 | | 24 | 75 |
| Onartuzumab5 | | 89 | 11 |
| Onartuzumab6 | 2.2 | 98 | |

Example 7

Production and Analysis of Charged Aglycosylation Mutants

The identification of stable multivalent Ab formats is described below. Protein constructs were used that do not contain binding sites. Several formats were compared as shown in Table 23 and FIG. 17.

TABLE 23

| TFcs | | |
|---|---|---|
| Name of tandem Fc | Modifications to TFc CH2 domain | SEQ ID NOs of TFc (aa/nucleotide) |
| Glyco_wt | None | 357/358 |
| Glyco_1 | N297D/T299S::N297D/T299S | 388/389 |
| Glyco_2 | T299K::N297D/T299S | 390/391 |
| Glyco_3 | N297D/T299S::T299K | 392/393 |
| Glyco_4 | N299K::N299D | 394/395 |
| Glyco_5 | N299D::N299K | 396/397 |
| Glyco_6 | N299D::N299D | 398/399 |

Nucleic acids (having SEQ ID NOs:357, and 389-399 (odd numbers) were transiently transfected into Freestyle 293F cells and purified with a one-step protein A purification followed by DSF essentially as described in Example 4.

TABLE 24

| Percentage monomer of TFcs after exposure to various conditions | | | |
|---|---|---|---|
| Protein | Condition | mg/ml | % monomer |
| Glyco_wt | Initial purification | 10.6 | 86.6 |
| | 4 deg, 0 day | 10.6 | 79.7 |
| | Agitate | 10.6 | 79.3 |
| | 4 deg, 10 day | 10.6 | 78.6 |
| | 37 deg, 10 day | 10.6 | 75.5 |
| | 4 deg, 1 month | 10.6 | 77.5 |
| Glyco_1 | Initial purification | 3.7 | 83.2 |
| | 4 deg, 0 day | 11.2 | 83.0 |
| | Agitate | 11.2 | 82.6 |
| | 4 deg, 10 day | 11.2 | 82.4 |
| | 37 deg, 10 day | 11.2 | 80.3 |
| | 4 deg, 1 month | 11.2 | 84.7 |
| Glyco_2 | Initial purification | 1.3 | 78.6 |
| | 4 deg, 0 day | 8.4 | 78.0 |
| | Agitate | 8.4 | n/d |
| Glyco_3 | Initial purification | 3 | 76.4 |
| | 4 deg, 0 day | 12 | 75.0 |
| | Agitate | 12 | n/d |
| | 4 deg, 10 day | 12 | 73.5 |
| | 37 deg, 10 day | 12 | 71.6 |
| Glyco_4 | Initial purification | 4.2 | 84.5 |
| | 4 deg, 0 day | 10.1 | 83.5 |
| | Agitate | 10.1 | 83.6 |
| | 4 deg, 10 day | 10.1 | 83.0 |
| | 37 deg, 10 day | 10.1 | 80.8 |
| Glyco_5 | Initial purification | 9.5 | 77.1 |
| | 4 deg, 0 day | 9.5 | 76.3 |
| | Agitate | 9.5 | 76.5 |
| | 4 deg, 10 day | 9.5 | 76.6 |
| | 37 deg, 10 day | 9.5 | 73.7 |
| | 4 deg, 1 month | 9.5 | 76.5 |
| Glyco_6 | Initial purification | 6.3 | 81.7 |
| | 4 deg, 0 day | 12 | 80.6 |
| | Agitate | 12 | 81.2 |
| | 4 deg, 10 day | 12 | 81.0 |
| | 37 deg, 10 day | 12 | 77.3 |
| | 4 deg, 1 month | 12 | 80.8 |

B) SDS PAGE Analysis

Figure 13A:
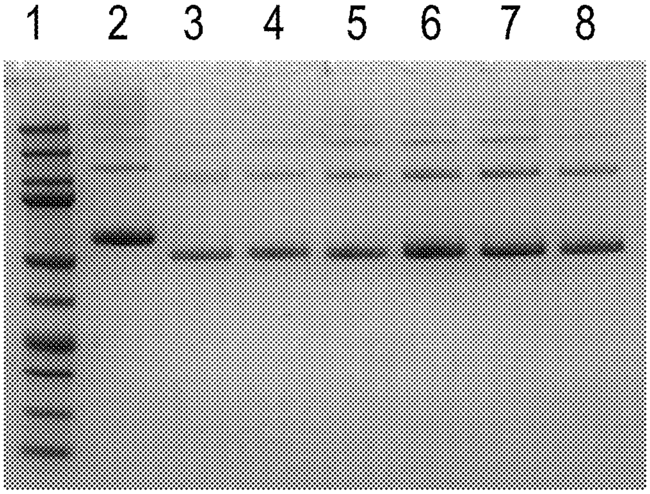
FIG. 13A: Non-reduced SDS-PAGE of charged glycosylation mutants: Lane 1=size standards, Lanes 2-8; 2=glyco wt, 3=glyco 1, 4=glyco 2, 5=glyco 3, 6=glyco 4, 7=glyco 5, 8=glyco 6.

The TFcs were run on a 4-12% SDS-PAGE gel in denaturing conditions and visualized by Coomassie stain. The results are shown in FIG. 13A (non-reduced) and FIG. 13B (reduced).

C) Thermal Stability Measurement by DSF

The temperature at which a TFcA or TFc unfolds is determined by Differential Scanning Fluorimetry (DSF) essentially as follows. The DSF assay is performed in the IQ5 Real Time Detection System (Bio-Rad). 20 μl solutions of 15 uM TFcA or TFc, 1× Sypro Orange (Invitrogen Life Technologies), and 1×PBS are added to the wells of a 96 well plate. The plate is heated from 20° C. to 90° C. with a heating rate of 1° C./min. Data is transferred to GraphPad Prism for analysis. Exemplary results from thermal stability determination by DSF for glycosylation site mutants are shown in Table 25.

TABLE 25

| DSF of Tandem Fcs | |
|---|---|
| protein | Tm |
| glyco_wt | 60.5 |
| glyco_1 | 55.5 |
| glyco_2 | 57.9 |
| glyco_3 | 57.9 |
| glyco_4 | 57.3 |
| glyco_5 | 56.3 |
| glyco_6 | 51.5 |

Example 8

DSF Analysis of Backbone Variants

Thermal Stability Measurement by DSF

The temperature at which a TFcA or TFc unfolds is determined by Differential Scanning Fluorimetry (DSF) as described above. Results are shown in Table 26 below. These data show that backbone modifications such as the addition of a disulfide bridge and glycosylation mutations can improve thermal stability.

TABLE 26

| DSF of Tandem Fcs with backbone variations | |
|---|---|
| Protein | Tm |
| Onartuzumab | 57.1 |
| Onartuzumab-23 | 46.9 |
| Onartuzumab-39 | 51.2 |
| Onartuzumab-23E | 57.8 |
| Onartuzumab-39Egy4 | 60.3 |
| Onartuzumab-39Egy4-cetuximab | 57.3 |
| Onartuzumab-39Egy4-panitumumab | n/a |
| Onartuzumab-39Egy4-2224 | 55.7 |

Example 9

Production and Analysis of Monovalent and Bispecific tFc Molecules Using Onartuzumab Binding Site Percent Monomer Determination Using Size Exclusion Chromatography 50 μg of sample is injected on a TSKgel SuperSW3000 column (4.6 mm ID×30 cm) using 20 mM sodium phosphate (+300 mM NaCl) as running buffer. All measurements are performed on Agilent 1100 HPLC which is equipped with an auto sampler, a binary pump and a diode array detector. Percent monomers are determined by analyzing the data in Chemstation software. Typically, all the samples are only protein A purified and at a concentration of 5 mg/mL in 1×PBS.

TABLE 27

| SEC Stability of TFcBA molecules at 4° C. | | |
|---|---|---|
| Molecule name | Percent monomers (Day 0) | Percent monomers (Day 7) |
| Onartuzumab-23 | 72 | 76 |
| Onartuzumab-39 | 70 | 76 |
| Onartuzumab-23E | 89 | 89 |
| Onartuzumab-39EGY4 | 81 | 81 |
| Onartuzumab-39EGY4-2224 | 88 | 88 |
| Onartuzumab-39EGY4-panitumumab | 85 | 85 |
| Onartuzumab-39EGY4-cetuximab | 82 | 83 |

Fortebio Binding Protocol

Materials required: 96-well, black, round, flat bottom, polypropylene microplates (Greiner Bio-one #655209). Octet instrument and software (version 3.0). Protein A sensor tips (Fortebio, #18-5010). 1×PBS, antigen (his tagged cMET), antibodies.

Protocol: All reagents are equilibrated and samples are brought to room temperature. Protein A sensor tips (Fortebio, #18-5010) are hydrated for 10 min in 1×PBS. Kinetic assays are run using the Octet software and procedure per manufacturer's instruction. Assay steps typically include: 1-2 min of equilibration in 1×PBS, 4 min of antibody loading (conc: 50 µg/mL in 1×PBS), 1-2 min of baseline stabilization, 4 min of antibody:antigen association, and 4 min of antibody:antigen dissociation. 1×PBS is used as the matrix throughout. Data are analyzed with Octet Data Analysis software, processed, and fit to the curve using 1:1 binding model to determine kinetic parameters ($K_d$, $K_{on}$ and $K_{off}$)

TABLE 28

| $K_d$ of anti-cMet TFcs with various backbone modifications | |
|---|---|
| Molecule or antibody name | $K_d$ determined by Fortebio (Binding to cMET.his) |
| Onartuzumab-23E | 1.3 nM |
| Onartuzumab-39EGY4 | 1.25 nM |
| Onartuzumab-23 | 1.24 nM |
| Onartuzumab-39 | 1.26 nM |
| Onartuzumab-39EGY4-224 | 1.29 nM |
| Onartuzumab-39EGY4-cetuximab | 0.9 nM |
| Onartuzumab-39EGY4-panitumumab | 1.6 nM |
| Onartuzumab | 1.2 nM |

Example 10

Signaling Inhibition by Onartuzumab and Bispecific Variants

To test the ability of the constructs in Table 28 to inhibit pMet, the TFc variants were tested in HGF-induced SW620 cells (ATCC cat #: CCL-227) as follows: On day 1, actively mid-log (about 80% confluence) growing cells (e.g., SW620 cells) are split in RPMI (+10% FBS+L/glutamine (2 mM)+ Pen/Strep) media. Approximately 20,000 cells are seeded/ well in a 96-well plate. On day 2, the media is changed from 10% FBS to serum-free media—RPMI+0.5% FBS (+L/ glutamine+Pen/Strep) media. On day 3, the HGF (stimulated control) and various inhibitors/antibodies are diluted into the appropriate volume of serum free media. 100 µL of each inhibitor per concentration is added/well. The inhibitor is allowed to incubate at 37° C. for 2 hours. The cells are then washed 2× with cold PBS and later lysed in 50 µL/well of MPER (cat #PI78505, VWR International)+150 mM NaCl+ Protease and Phosphatase Inhibitor buffer (cOmplete Protease Inhibitor Cocktail Tablet provided in EASY packs, cat #4693124001, Roche Diagnostics Corp; PhosSTOP Phosphatase Inhibitor Cocktail Tablets, cat #4906837001, Roche Diagnostics Corp). The lysates are placed in −80° C. usually within 5 minutes after lysis.

For measurement of pMet signal, an ELISA kit was used (Human Phospho-HGF R/c-MET DuoSet IC Economy Pack, cat #DYC2480E, R&D Systems). A 384-well High Binding Black Solid plate from Corning is coated with capture anti-MET antibody from R&D Systems at a final concentration of 4 µg/mL/well in PBS buffer. The plates are left at overnight at room temperature. On day 4, the −80° C. lysate is thawed at room temperature. Plates are then washed 3 times with 50 µl/well in the BIOTEK plate washer with PBST (PBS with 0.05% Tween-20). The 384-well plates are blocked with 50 µL/well 2% BSA/PBS for 1 hour at room temperature. Duplicate lysates are pooled into one well and diluted 2-fold in 2% BSA/0.1% Tween-20/25% MPER/PBS. Recombinant standard curves are prepared by making 10×2-fold serial dilutions in 2% BSA/0.1% Tween-20/25% MPER/PBS. ELISA plates are washed with 0.05% Tween-20/PBS. 20 µL lysates are transferred from the 96-well plate in quadruplicate to the 384-well plate. Plates are incubated at room temperature for 2 hours and washed 3 times with 0.05% Tween-20/PBS. 20 µL primary detection anti-phosphotyrosine antibody, 4G10 (cat#05-321, Millipore/Upstate), is added at a dilution of 1:1000 to the ELISA plates and incubated for 1 hour at room temperature. 20 µL of SuperSignal ELISA Pico Chemiluminescent Substrate (cat #PI37069, VWR International) is added per manufacturer's directions and read on Envision Plate Reader (Perkin Elmer). For data analyses, duplicate samples are averaged and error bars are used to represent the standard deviation between the two replicates. Inhibition curves and corresponding IC50 values are calculated using GraphPad Prism software (GraphPad Software, Inc.) via regression of the data to a 4 parameter logistic equation.

Figure 16:
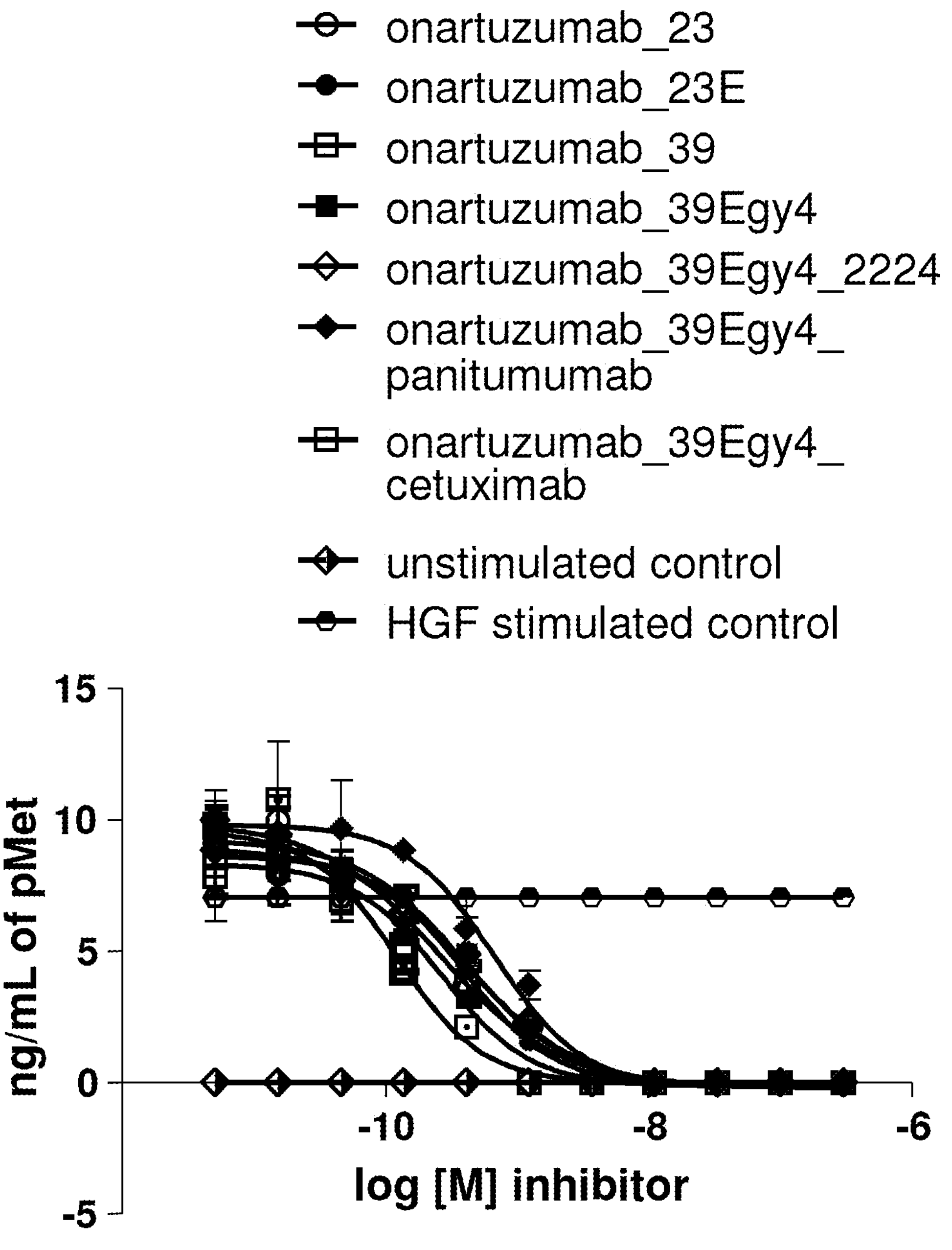
FIG. 16: A graph showing inhibition of pMet by TFcs comprising onartuzumab antibody and various backbones including 23, 23E, 39, 39E glycoform 4 backbone, and including TFcBAs comprising 39E glycoform 4 backbone and 2224, cetuximab, or panitumumab antibody.

As shown in FIG. 16, all molecules tested inhibited pMet signaling in a similar manner, without regard to the identity of the TFc core region. The bivalent onartuzumab_39Egy4_2224, onartuzumab_39Egy4_panitumumab, and onartuzumab_39Egy4_cetuximab variants inhibited to a similar extent as did the monovalent onartuzumab_39Egy4 variant.

Equivalents

Those skilled in the art will recognize, or be able to ascertain and implement using no more than routine experimentation, many equivalents of the specific embodiments described herein. Such equivalents are intended to be encompassed by the following claims. Any combinations of the embodiments disclosed in the dependent claims are contemplated to be within the scope of the disclosure.

Incorporation by Reference

The disclosure of each and every U.S. and foreign patent and pending patent application and publication referred to herein is specifically incorporated by reference herein in its entirety.

FURTHER EXAMPLES

Section A-1

The following examples should not be construed as limiting the scope of this disclosure.

Throughout the examples, the following materials and methods are used unless otherwise stated. In general, the practice of the techniques of the present disclosure employs, unless otherwise indicated, conventional techniques of chemistry, molecular biology, recombinant DNA technology, immunology (especially, e.g., antibody technology), pharmacology, pharmacy, and standard techniques in polypeptide preparation.

As used in these Examples and in the Figures, "HGF" refers to the hepatocyte growth factor (sometimes referred to as scatter factor), e.g., Preprotech, catalog #100-39.

The human cell lines used in the techniques and examples described below may be obtained, as indicated, from American Type Culture Collection (ATCC, Manassas, Va.). Cell lines used in the examples are: A549 cells (ATCC CCL-185); NCI-H441 (ATCC HTB-174); HCC827 (ATCC CRL-2868); NCI-H2170 (ATCC CRL-5928); and U-87 MG (ATCC HTB-14).

The humanized, anti-human-c-Met monoclonal antibody OA-5D5, as disclosed in U.S. Pat. No. 8,361,744 with SEQ ID NO:45 (heavy chain) and SEQ ID NO:46 (light chain), and from U.S. Patent Publication No. 20110300146 with SEQ ID NO:196 (knob) is used as an anti-c-Met antibody control. In some embodiments, the anti-c-Met heavy chain and knob sequences each have a single mutation SEQ ID NO:45 and SEQ ID NO:196 to remove the CH2 glycosylation site. For example, see U.S. Pat. No. 7,476,724.

Antibodies described in this disclosure are abbreviated with the following style: e.g. Antibody #1 is Ab#1, Antibody #2 is Ab#2, Antibody #13 is Ab#13, etc.

Example A-1

Tandem-Fc Bispecific Antibody Format

Figure 18:
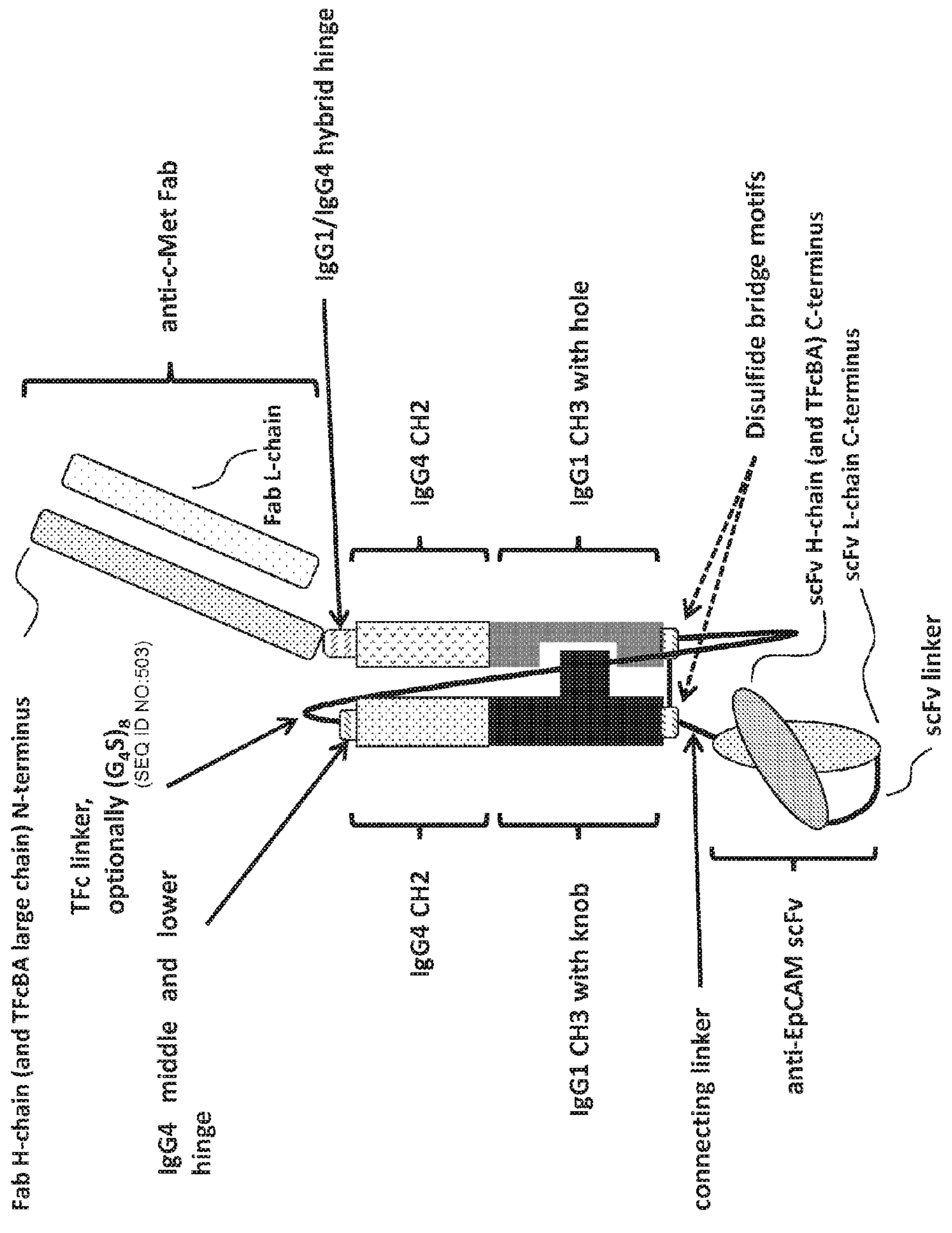
FIG. 18: Diagram of an exemplary anti-c-Met/anti-EpCam Tandem Fc Bispecific Antibody ("TFcBA"). In an embodiment, the CH2 domain may comprise an electrostatic region such as a complementarity region. Figure discloses "$(G_4S)_8$" as SEQ ID NO: 491.
Figure 20:
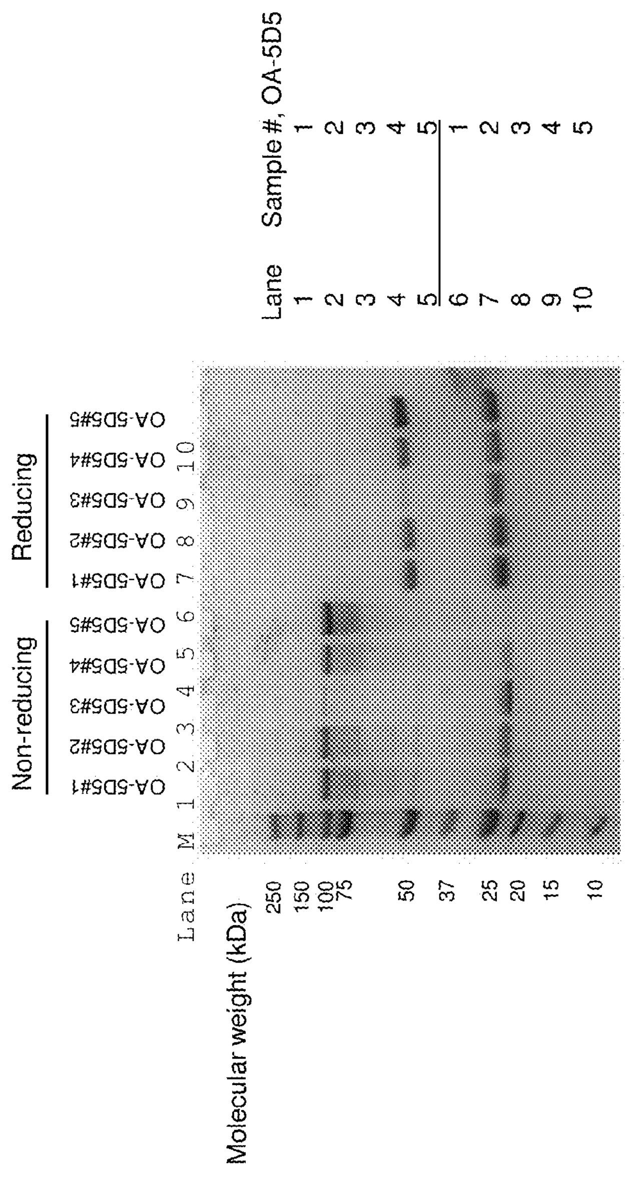
FIG. 20: SDS gel of variants of antibody OA-5D5 (IgGs).
Figure 21:
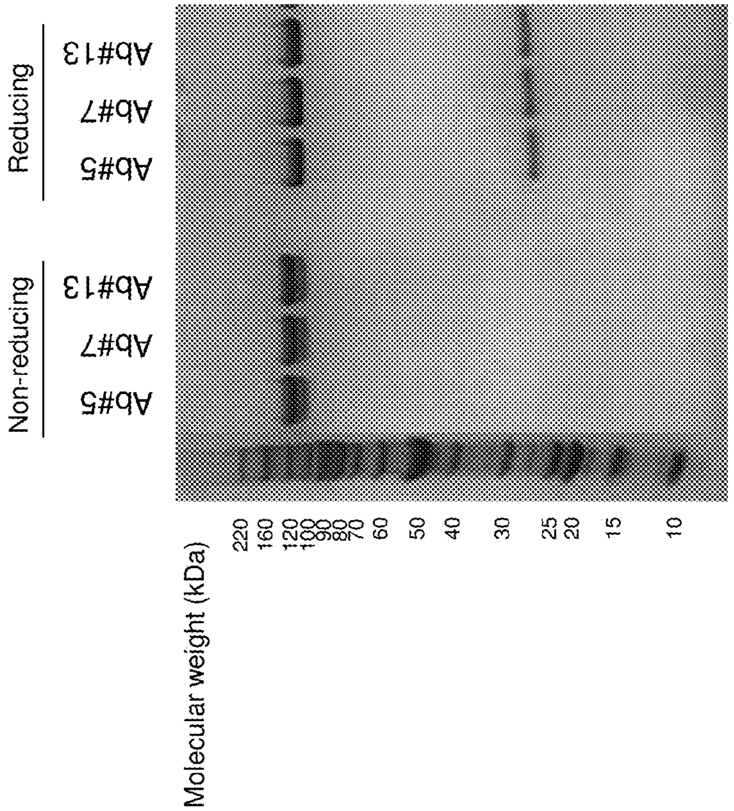
FIG. 21: SDS gel of anti-c-Met/anti-EpCam Tandem Fc Bispecific Antibodies Ab#5, Ab#7, and Ab#13.

The general structure of the bispecific antibodies disclosed herein comprises a bivalent antibody with a single Fab directed against c-Met, a "tandem-Fc' (TFc) backbone structure (described in copending PCT Application Serial No. PCT/US2012/52490, e.g., SEQ ID NO:394 and 395), and a single scFv antibody fragment directed against EpCAM. The heavy chain of the bispecific antibody comprises a single polypeptide containing the following domains (N-terminus to C-terminus):

(i) Heavy chain of the c-Met Fab
(ii) Hybrid hinge containing IgG1 upper hinge and IgG4 middle and lower hinge
(iii) IgG4 CH2 domain #1 with T299K mutation
(iv) IgG1 CH3 domain #1 with T366S/L368A/Y407V mutations
(v) Disulfide bridge motif #1 (KSCDKT) (SEQ ID NO: 167)
(vi) $(G_4S)_8$ (SEQ ID NO: 491) polypeptide linker
(vii) Middle and lower hinge of IgG4
(viii) IgG4 CH2 domain #2 with T299D mutation
(ix) IgG1 CH3 domain #2 with T366W mutation
(x) Disulfide bridge motif #2 (GEC) (SEQ ID NO: 168)
(xi) Connecting polypeptide linker
(xii) Anti-EpCAM scFv A schematic of the antibody domain structure can be found in FIG. 18.

Example A-2

Humanization of Anti-EpCAM scFv

A structure-guided approach was employed to create a panel of 13 humanized anti-EpCAM scFv variants deriving from the murine parent sequence (SEQ ID NOs: 486 & 487). The initial homology models of scFvs were built by MolIDE using independent zero-gap templates for VH and VL domains and energy-refined using SCWRL A review of MolIDE and SCWRL is disclosed, e.g., in *Nature Protocols* 3:1832-1847 (2008). The potential impact of the candidate mutations on stability was conducted by visual inspection using PyMOL or calculating energy differences using Eris. These scFv variants were incorporated into 13 bispecific antibodies (Ab#1, Ab#2, Ab#3, Ab#4, Ab#5, Ab#6, Ab#7, Ab#8, Ab#9, Ab#10, Ab#11, Ab#12, and Ab#13). Permutations used include three different antibody frameworks, removal of deamidation or oxidation sites in the CDR sequences, VH/VL sequence orientation, disulfide bridge addition, and intra-scFv protein linker sequence. An overview of the design permutations tested is shown in FIG. 2.

Example A-3

Protein Expression and Purification of Antibodies

A) Transient Transfection

Antibodies are expressed using a transient transfection protocol utilizing Freestyle 293F cells (Invitrogen). The nucleic acids encoding the proteins are cloned as single proteins into expression plasmids using standard recombinant DNA techniques. An exemplary expression vector employed is pCEP4 (Life Technologies, catalog #R790-07). Heavy chain and light chain sequences for the antibodies are cloned into separate vectors. Expression plasmids are transfected using polyethylene imine (2.5 μg per ml of cell culture) and DNA (1:1 ratio of heavy chain and light chain, with a combined total of 1 μg DNA per ml of cell culture). Transfected cells are incubated at 37° C., 5% $CO_2$ for six days and then harvested by centrifugation at 6000 g for 30 minutes followed by 0.2 μM filtration of the supernatant.

B) Stable Transfection

Antibodies are expressed via stable transfection into suspension adapted CKO-K1 cells (Chinese hamster ovary; ATCC catalog #CCL-61) essentially as follows. The nucleic acids encoding the antibodies are cloned as single proteins into expression plasmids using standard recombinant DNA techniques. An exemplary expression vector employed is pMP 10K (SELEXIS). Heavy chain and light chain sequences for the antibodies are cloned into separate vectors. Heavy and light chain expression plasmids are linearized, purified using QIAquick purification kit (QIAGEN), and co-transfected at a 1:1 ratio as follows.

Suspension-adapted CHO-K1 cells are grown in Hyclone SFM4-CHO media (Fisher Scientific, catalog #SH30548.02) supplemented with 8 mM L-glutamine (Life Technologies, catalog #25030-081) to a density of 2 million cells per ml. On the day of transfection, the cells are resuspended in Opti-MEM serum free media (Gibco, catalog #31985-062) at a density of 80,000 cells per ml. The cells (500 μL) are then transfected with 1 μg of total linearized DNA (including 10 ng of pNeo vector, an in-house vector carrying the geneticin selection marker) using 2.75 μL of Lipofectamine (Life Technologies, catalog #15338-100) in a 24 well plate. After 3 hours, 1 ml of recovery media (HAMS-F12 (Gibco)+10% FBS) is added, and the transfected cells allowed to recover for 48 hours. The cells are then expanded into a 96-well plate, and the selection marker geneticin was added to the recovery media at 500 μg/ml. After 4 more days, the media is replaced with serum free Hyclone SFM4-CHO media (supplemented with L-glutamine), and the transfected cells allowed to adapt. After a week, the selected cells form colonies, and the wells containing single colonies are tested for desired characteristics with western blots from the supernatant. The desired clones are expanded to a 24 well plate, then to a T-25 flask, and eventually to a 125 ml shake flask. Expression of antibody by the desired clones are confirmed with SDS-PAGE, and scaled up to the desired volume. The cells are harvested by centrifugation (6000 g, 30 min) when the viability falls below 80%, and the supernatant filtered using a 0.22 μm filter. Cell viability is assessed using trypan blue exclusion assay and is measured automatically using a Vi-CELL Cell Viability Analyzer (Beckmann Coulter).

C) Purification

All proteins are purified using a protein A affinity chromatography protocol in accordance with manufacturer's instructions, using MabSelect (GE Healthcare) as the Protein A affinity resin, on a AKTA Explorer 100 FPLC (GE Healthcare). The protein A affinity step is used to selectively and efficiently bind the antibodies out of harvested cell culture fluids. This removes >95% of product impurities in a single step with high yields and high throughput. The purified material is concentrated using VIVASPIN® centrifugal concentrators (GE Healthcare), and dialyzed into PBS using Slide-A-Lyzer G2 Dialysis Cassettes (Pierce), both according to manufacturer's instructions.

Example A-4

Biophysical Characterization of Expressed Antibodies

A) SDS-PAGE Analysis

Sodium dodecyl sulfate polyacrylamide gel electrophoresis (SDS-PAGE) is used to assess the molecular weight of expressed antibodies, and determine whether an antibody is properly formed or assembled. Antibodies (2 μg each) are run on a 4-12% SDS-PAGE gel in either non-reducing or reducing conditions and visualized by Coomassie brilliant blue stain.

OA-5D5 was expressed using stable transfection and purified as described above, and visualized using SDS-PAGE. FIG. 3 depicts results for OA-5D5 deriving from 5 different clones under reducing and non-reducing conditions. Under non-reducing conditions, all OA-5D5 clones were observed to have a band with molecular weight of approximately 100 kilodaltons, corresponding to properly associated monovalent antibody. OA-5D5 clones also showed a band at approximately 25 kilodaltons, likely corresponding to excess light chain or Fc domain. Under reducing conditions, all OA-5D5 clones demonstrated two bands of approximately 25 and 50 kilodaltons, likely corresponding to OA-5D5 light chain and Fc domain (25 kDa) and heavy chain (50 kDa).

Ab#5, Ab#7, and Ab#13 were expressed using stable transfection and purified as described above, and visualized using SDS-PAGE. FIG. 4 depicts results for Ab#5, Ab#7, and Ab#13 under reducing and non-reducing conditions. For both conditions, Ab#5, Ab#7, and Ab#13 were observed to run at the expected molecular weight. Under non-reducing conditions, Ab#5, Ab#7, and Ab#13 were observed to have largely a single band with molecular weight of approximately 125 kilodaltons, corresponding to properly associated antibody light and heavy chain. Under non-reducing conditions, two bands of approximately 25 and 100 kilodaltons were observed corresponding to antibody light and heavy chain.

B) Percent Monomer Determination Using Size Exclusion Chromatography

Size exclusion chromatography may be used to assess the purity of expressed antibodies by characterizing the presence of aggregates or antibody fragments. To assess the percent monomer of the antibodies, 50 μg of sample is injected on a TSKgel SuperSW3000 column (4.6 mm ID×30 cm; Tosoh Bioscience) using 20 mM sodium phosphate+300 mM sodium chloride as running buffer. All measurements are performed on an Agilent 1100 HPLC which is equipped with an auto sampler, a binary pump and a diode array detector. Percent monomers are determined by analyzing the data in Agilent ChemStation software. Typically, samples are only protein A purified and run at a concentration of 5 mg/ml in 1×PBS.

Ab#1, Ab#2, Ab#3, Ab#4, Ab#5, Ab#6, Ab#7, Ab#8, Ab#9, Ab#10, Ab#11, Ab#12, and Ab#13 were expressed using transient transfection and purified as described above, and OA-5D5 was expressed using stable transfection and purified as described above. All molecules were analyzed via size exclusion chromatography. Data on approximate percent monomeric character for the Protein A purified antibodies are shown below in Table 1.

TABLE A-1

| Antibody | Monomer percentage |
|---|---|
| Ab#1 | 74.2 |
| Ab#2 | 75.1 |
| Ab#3 | 74.2 |
| Ab#4 | 87.5 |
| Ab#5 | 86.5 |
| Ab#6 | 86.1 |
| Ab#7 | 87.1 |
| Ab#8 | 86.3 |
| Ab#9 | 95.1 |
| Ab#10 | 91.5 |
| Ab#11 | 90.4 |
| Ab#12 | 90.9 |
| Ab#13 | 92.2 |
| OA-5D5#1 | 78 |
| OA-5D5#2 | 75 |
| OA-5D5#3 | 24 |
| OA-5D5#4 | 89 |
| OA-5D5#5 | 98 |

Example 5

Binding Affinity of Antibodies to Recombinant c-Met and EpCAM

Kinetic assays to measure the association rate, dissociation rate, and binding affinity of antibodies for, e.g., the molecular targets c-Met and EpCAM may be measured using the Octet platform (ForteBio) per manufacturer's instructions. Materials required are as follows:

96-well black flat bottom polypropylene microplates (Greiner Bio-one #655209)
Octet instrument and software (version 3.0)
Protein A sensor tips (ForteBio, #18-5010)
1×PBS
Recombinant polyhistidine-tagged c-Met
Recombinant polyhistidine-tagged EpCAM-Fc For Octet analysis, all reagents and samples are brought to room temperature. Protein A sensor tips (ForteBio, #18-5010) are hydrated for 10 minutes in 1×PBS. Assay steps include: 1-2 minutes of equilibration in 1×PBS, 4 minutes of antibody loading (concentration of 50 μg/ml in 1×PBS), 1-2 minutes of baseline stabilization, 4 minutes of antibody: antigen association, and 4 minutes of antibody:antigen dissociation. 1×PBS is used as the matrix throughout. Data are analyzed with Octet Data Analysis software, processed, and fit to a 1:1 binding model to determine kinetic parameters ($K_d$, $k_{on}$ and $k_{diss}$).

Table A-2 describes approximate EpCAM binding affinity and dissociation rate as determined for Ab#1, Ab#2, Ab#3, Ab#4, Ab#5, Ab#6, Ab#7, Ab#8, Ab#9, Ab#10, Ab#11, Ab#12, and Ab#13.

Table A-3 describes a repeat analysis for Ab#5, Ab#7, and Ab#13. For the repeat experiment, $K_d$ and $k_{diss}$ values for Ab#5, Ab#7, and Ab#13 are substantially equivalent to those determined for Ab#5, Ab#7, and Ab#13 in the initial experiment.

TABLE A-2

| Antibody | $K_d$ (M) | $k_{diss}$ (1/s) |
|---|---|---|
| Ab#1 | 1.37E−08 | 1.21E−03 |
| Ab#2 | no binding | no binding |
| Ab#3 | 1.70E−08 | 1.74E−03 |
| Ab#4 | 1.94E−08 | 1.74E−03 |
| Ab#5 | 3.57E−09 | 3.46E−04 |
| Ab#6 | 1.12E−08 | 1.22E−03 |
| Ab#7 | 2.59E−08 | 1.32E−03 |
| Ab#8 | 1.67E−08 | 9.80E−04 |
| Ab#9 | 1.00E−08 | 4.30E−04 |
| Ab#10 | 2.62E−08 | 2.11E−03 |
| Ab#11 | 4.57E−09 | 4.09E−04 |
| Ab#12 | 2.45E−08 | 1.66E−03 |
| Ab#13 | 4.98E−09 | 3.60E−04 |

TABLE A-3

| Antibody | $K_d$ (M) | $k_{diss}$ (1/s) |
|---|---|---|
| Ab#5 | 2.67E−09 | 1.94E−04 |
| Ab#7 | 1.54E−08 | 1.37E−03 |
| Ab#13 | 4.69E−09 | 3.23E−04 |

Table A-4 describes approximate c-Met binding affinity and dissociation rate as determined for Ab#5 and Ab#7.

TABLE A-4

| Antibody | $K_d$ (M) | $k_{diss}$ (1/s) |
|---|---|---|
| Ab#5 | 3.40E−09 | 5.88E−04 |
| Ab#7 | 2.81E−09 | 5.54E−04 |

Example A-6

Plate-Based Bispecific Antibody Binding Assay

The antibodies disclosed herein are designed to simultaneously bind both EpCAM and c-Met. A plate-based sandwich-type assay may be used to demonstrate the co-binding of the antibodies. The assay is performed as follows. Reacti-Bind 96-well plates (Pierce, catalog #15041) are coated with 50 μL of 2 μg/ml cMet-Fc (Merrimack Pharmaceuticals) in PBS, and incubated overnight at 4° C. On the next day, the plates are washed with PBS-T (PBS+0.05% Tween-20), blocked for 1 hour at room temperature with 100 μL of Protein-Free Blocking Buffer (Pierce, catalog #37572), and washed again with PBS-T. Plates are next incubated for 2 hours at room temperature with 100 μL of antibody in PBS-T+10% FBS (highest antibody concentration of 500 nM, with 10 subsequent three-fold dilutions, and one blank well for background subtraction). The plates are washed with PBS-T, and 50 μl of 1 μg/ml EpCAM-Fc-His (Merrimack Pharmaceuticals) in PBS-T is added for 1 hour at room temperature. Plates are washed with PBS-T and 50 μl of anti-His-HRP (Abcam, catalog #ab1187; 1:20,000 in PBS-T) is added and incubated (covered) for 1 hour at room temperature. Plates are again washed with PBS-T, followed by addition of 100 μl of 3,3',5,5'-tetramethylbenzidine (TMB; Cell Signaling, catalog #7004) and incubation between 5-15 minutes at room temperature. The substrate reaction is stopped with 100 μl of Stop Solution (Cell Signaling, catalog #7002). The well absorbance is measured at 450 nm using an Envision plate reader (PerkinElmer), and the resulting data analyzed and plotted using GraphPad Prism (GraphPad Software, Inc.).

Figure 22:
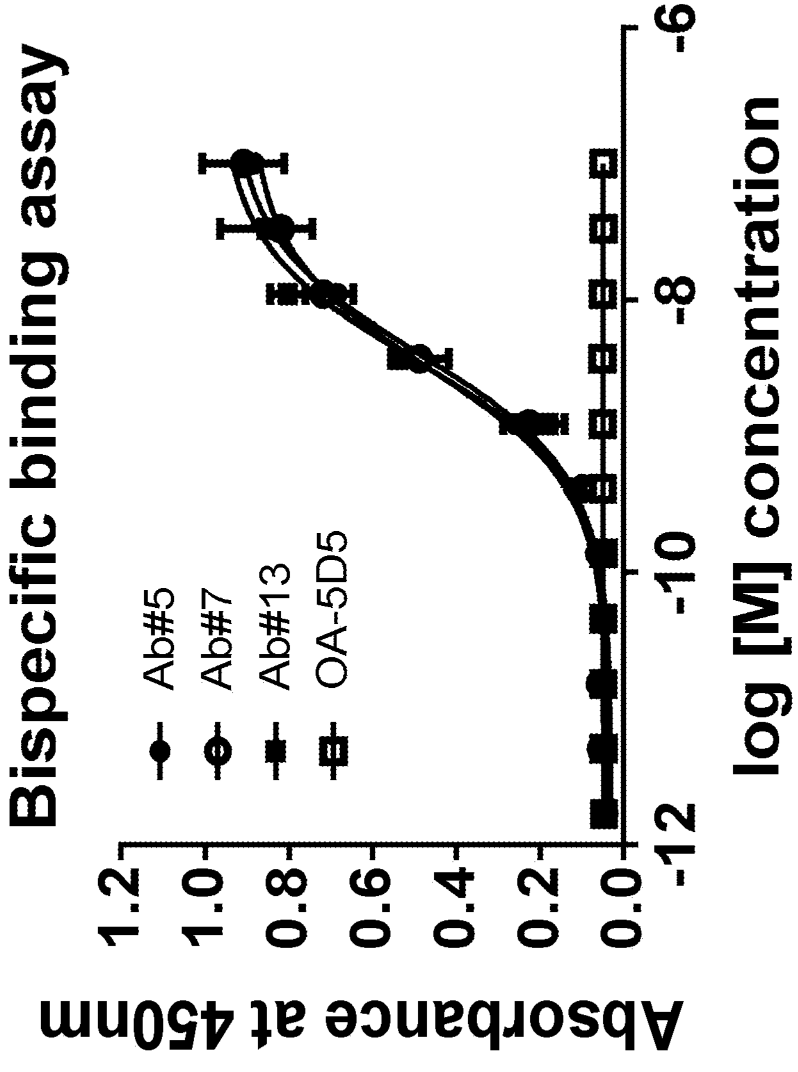
FIG. 22: Bispecific binding assay data obtained with anti-c-Met/anti-EpCam Tandem Fc Bispecific Antibodies Ab#5, Ab#7, and Ab#13.
Figure 23:
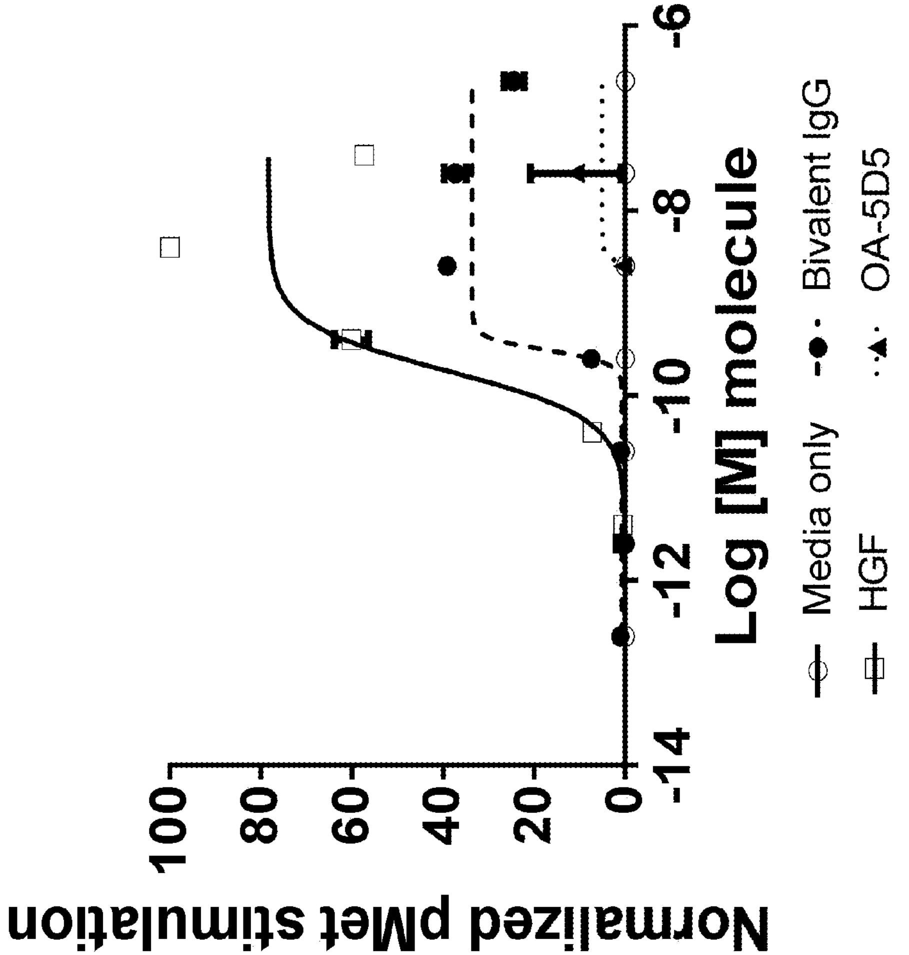
FIG. 23: Comparison of Met phosphorylation induced by incubation with monovalent (OA-5D5), bivalent anti-c-Met antibodies, HGF, or media only control.
Figure 24:
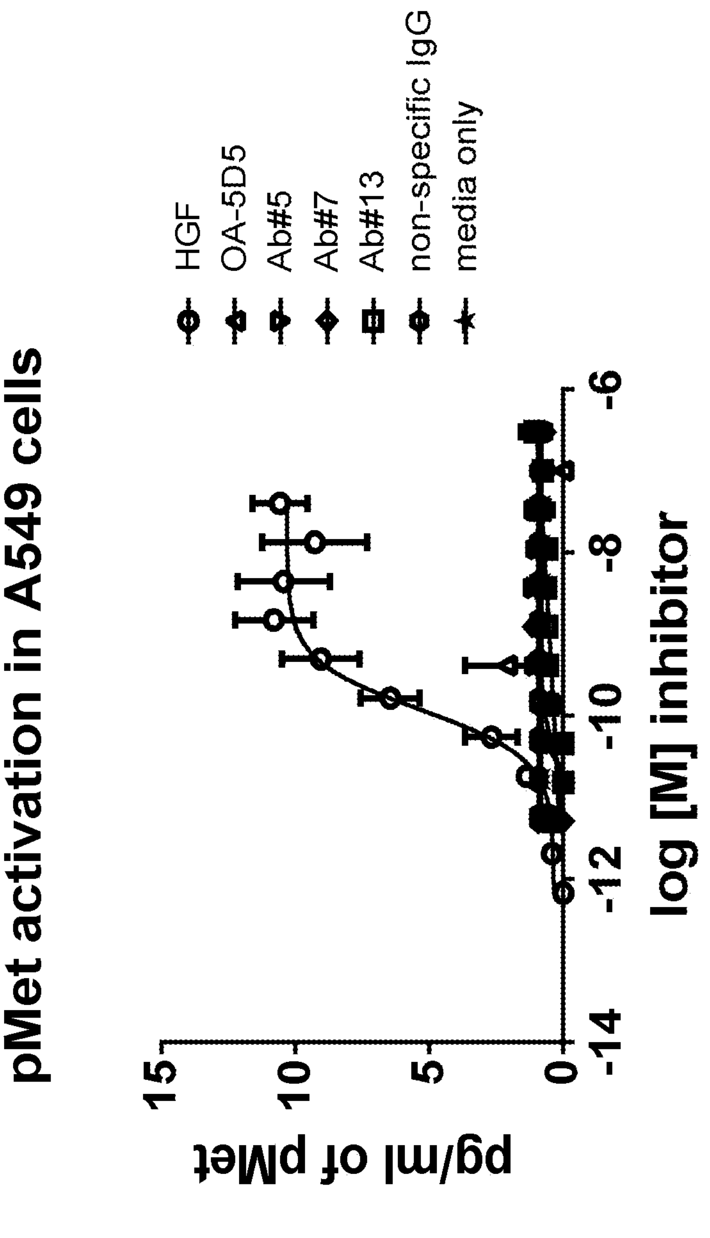
FIG. 24: Comparison of Met phosphorylation induced by incubation of A549 cells with monovalent (OA-5D5), bivalent anti-c-Met antibodies, HGF, anti-c-Met/anti-EpCam Tandem Fc Bispecific Antibodies Ab#5, Ab#7, or Ab#13, or media only control.
Figure 25A:
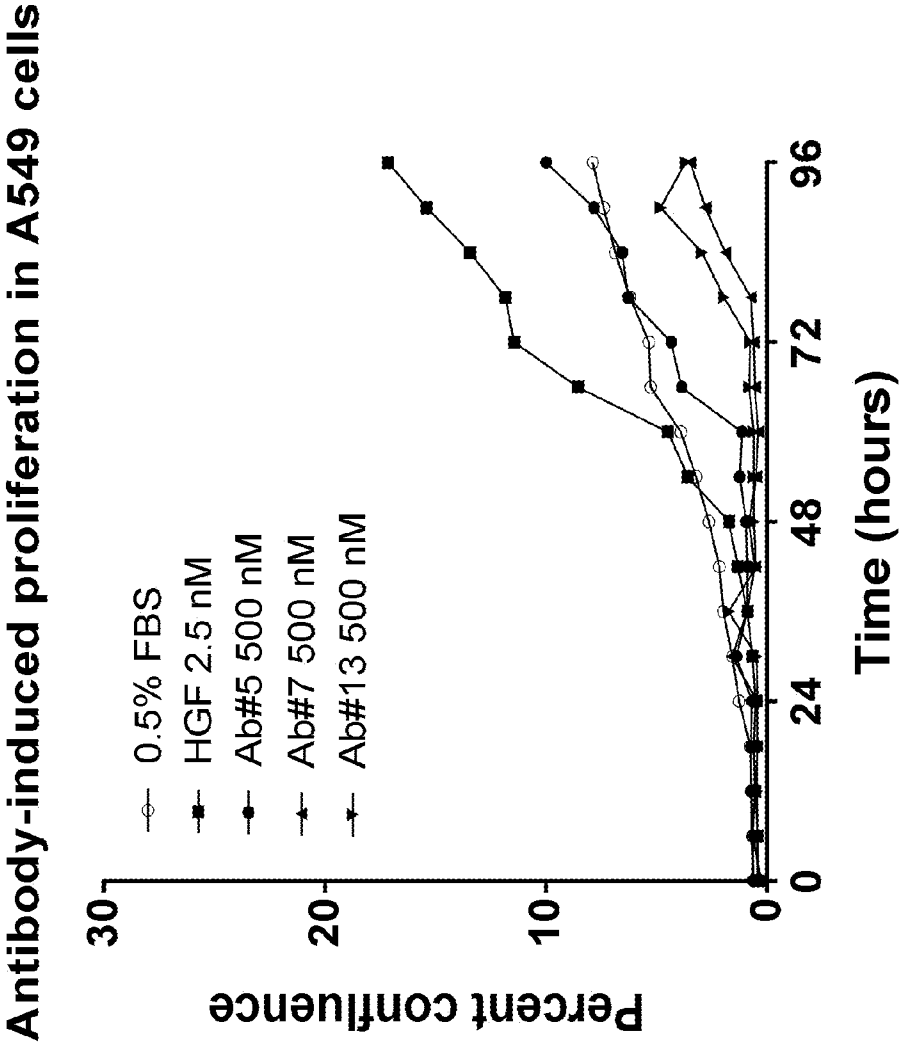
FIG. 25A: Comparison of proliferation induced by incubation of A549 cells with HGF, fetal bovine serum (FBS), and anti-c-Met/anti-EpCam Tandem Fc Bispecific Antibodies Ab#5, Ab#7, or Ab#13.
Figure 25B:
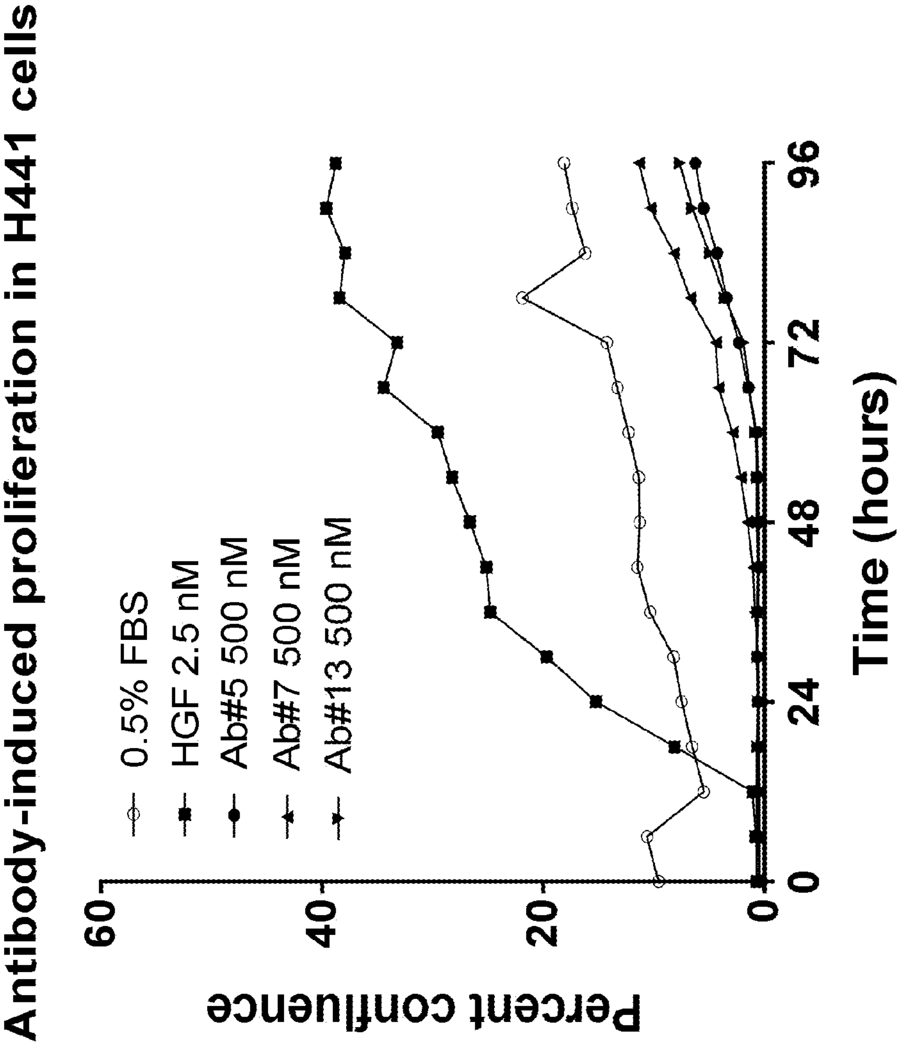
FIG. 25B: Comparison of proliferation induced by incubation of H441 cells with HGF, fetal bovine serum (FBS), and anti-c-Met/anti-EpCam Tandem Fc Bispecific Antibodies Ab#5, Ab#7, or Ab#13.
Figure 25C:
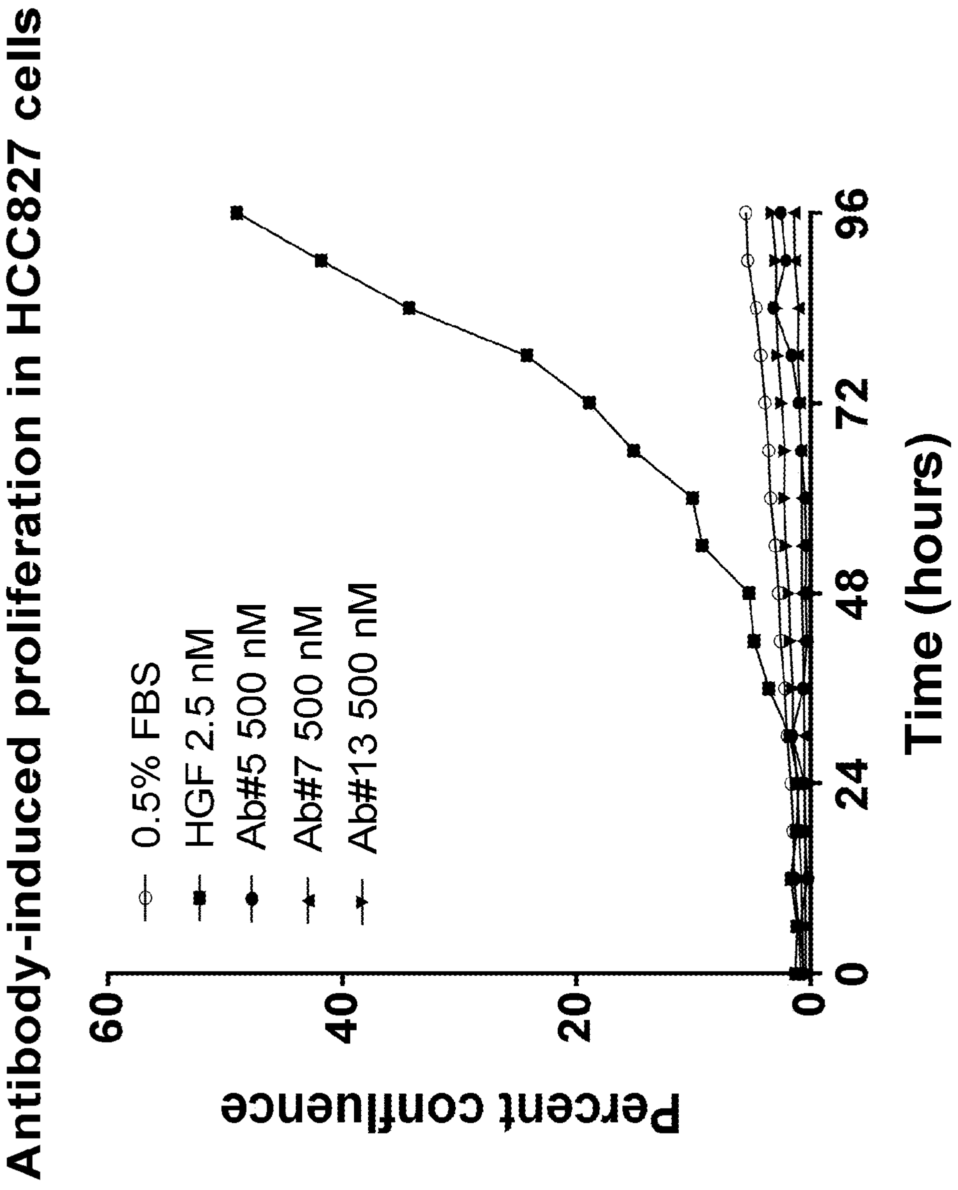
FIG. 25C: Comparison of proliferation induced by incubation of HCC827 cells with HGF, fetal bovine serum (FBS), and anti-c-Met/anti-EpCam Tandem Fc Bispecific Antibodies Ab#5, Ab#7, or Ab#13.
Figure 26:
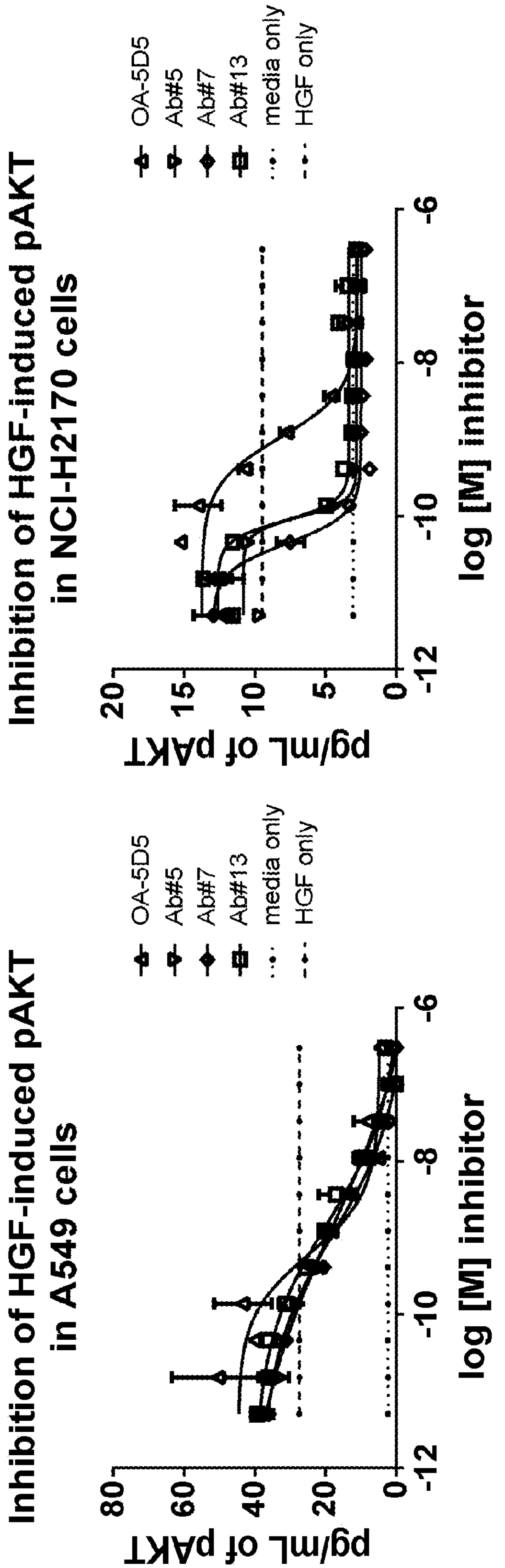
FIG. 26: Comparison of inhibition of HGF-induced phosphorylation of AKT by monovalent anti-c-Met antibody OA-5D5, and anti-c-Met/anti-EpCam Tandem Fc Bispecific Antibodies Ab#5, Ab#7, and Ab#13 in A549 cells and NCI-H2170 cells.
Figure 27:
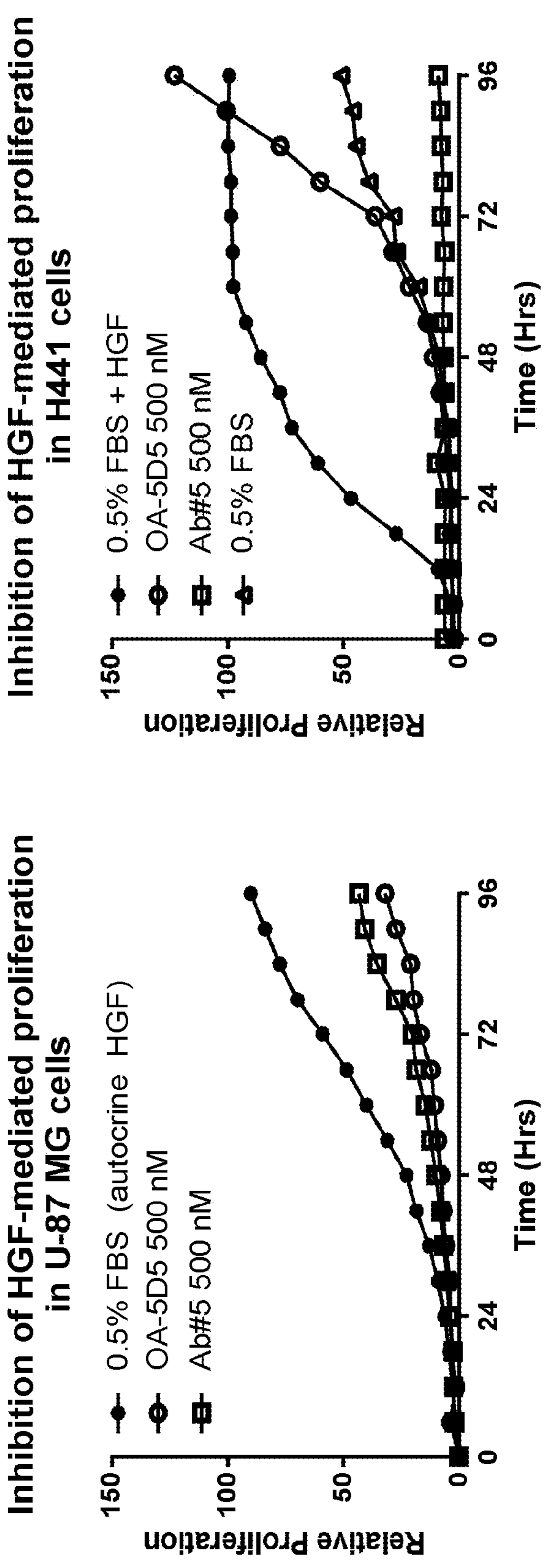
FIG. 27: Comparison of inhibition of HGF-induced proliferation by monovalent anti-c-Met antibody OA-5D5, and anti-c-Met/anti-EpCam Tandem Fc Bispecific Antibody Ab#5 in U-87 MG cells and H441 cells.
Figure 28:
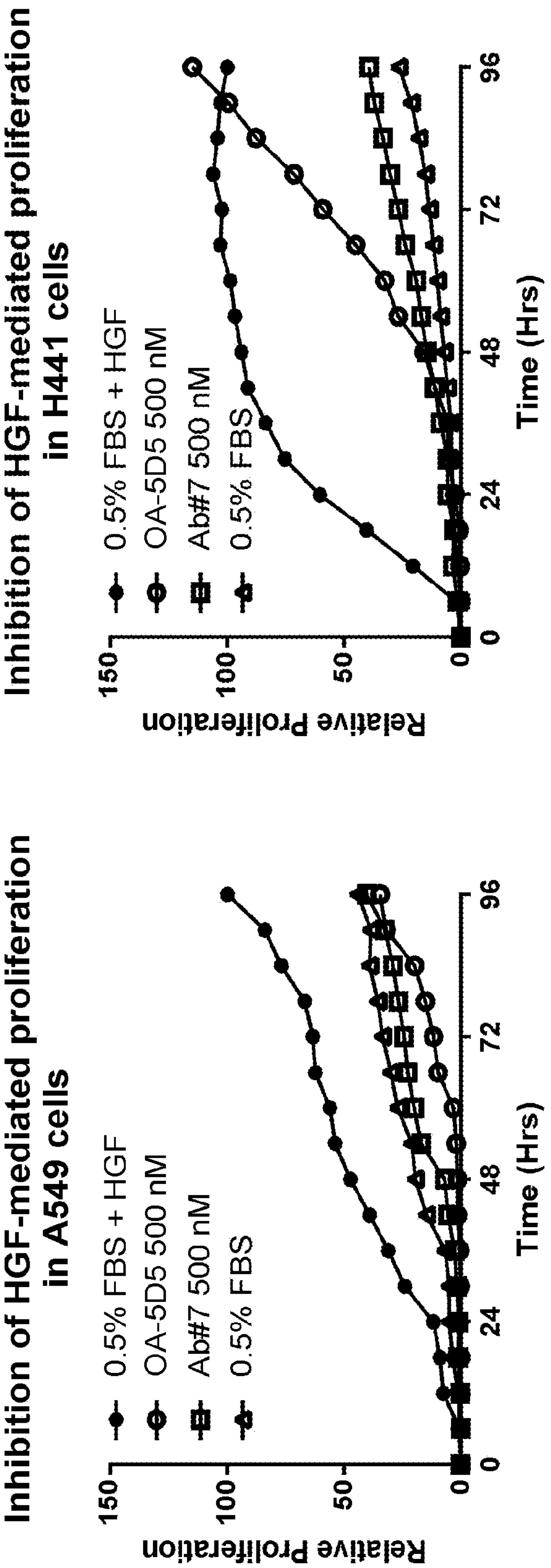
FIG. 28: Comparison of inhibition of HGF-induced proliferation by monovalent anti-c-Met antibody OA-5D5, and anti-c-Met/anti-EpCam Tandem Fc Bispecific Antibody Ab#7 in A549 cells and H441 cells.
Figure 29:
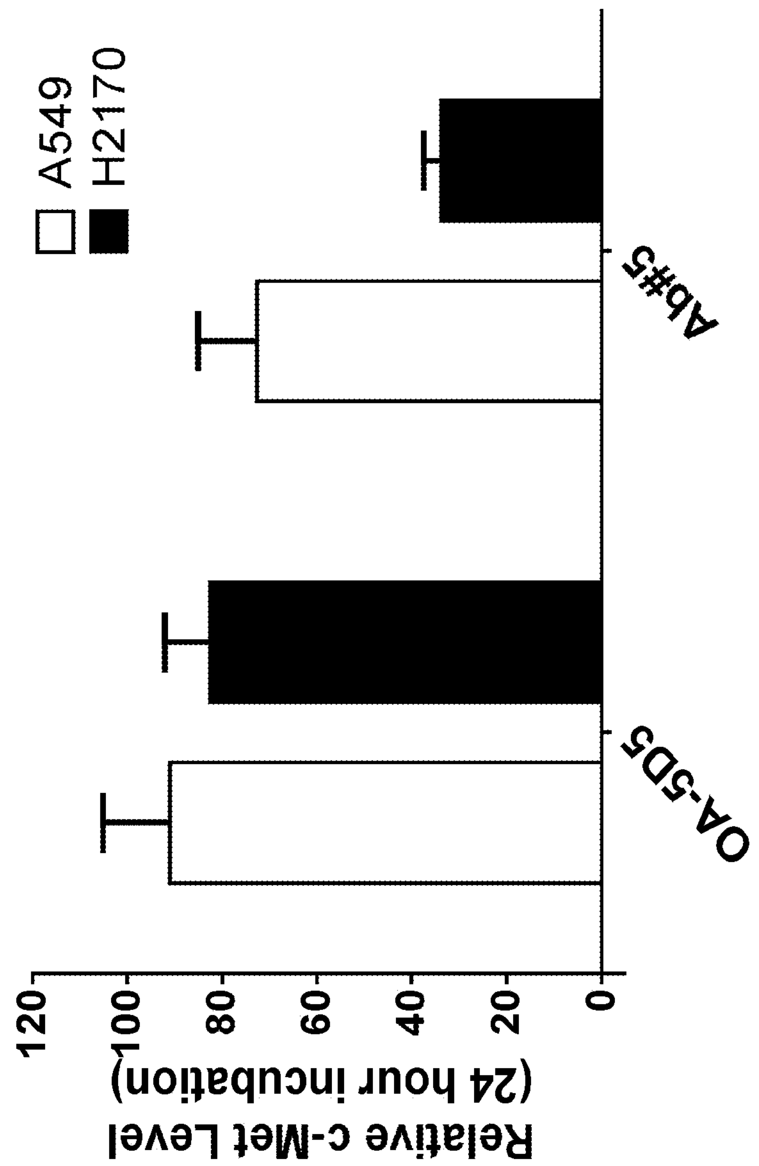
FIG. 29: Downregulation of cMet levels in A549 cells and H2170 cells by anti-c-Met/anti-EpCam Tandem Fc Bispecific Antibody AB#5 but not by monovalent anti-c-Met antibody OA-5D5.
Figure 30A:
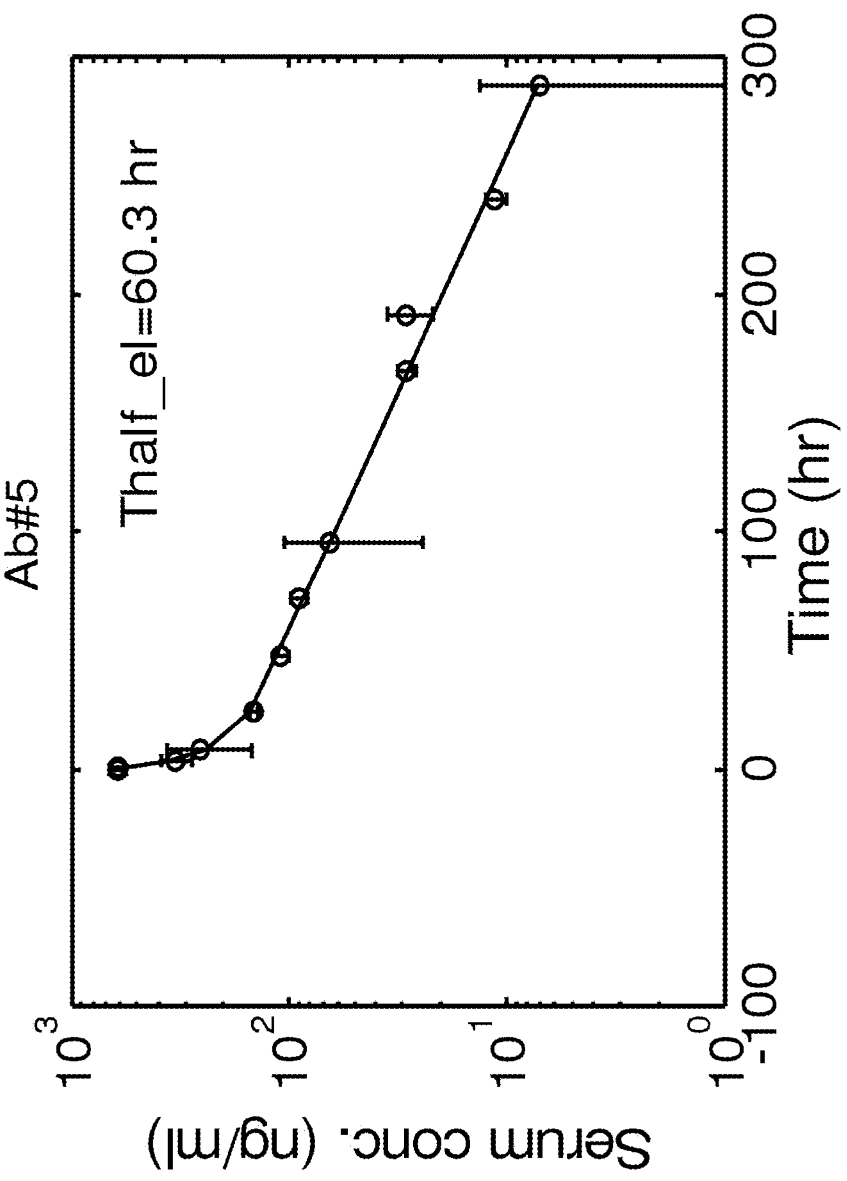
FIG. 30A: Murine pharmacokinetics—terminal half life of anti-c-Met/anti-EpCam Tandem Fc Bispecific Antibody Ab#5.
Figure 30B:
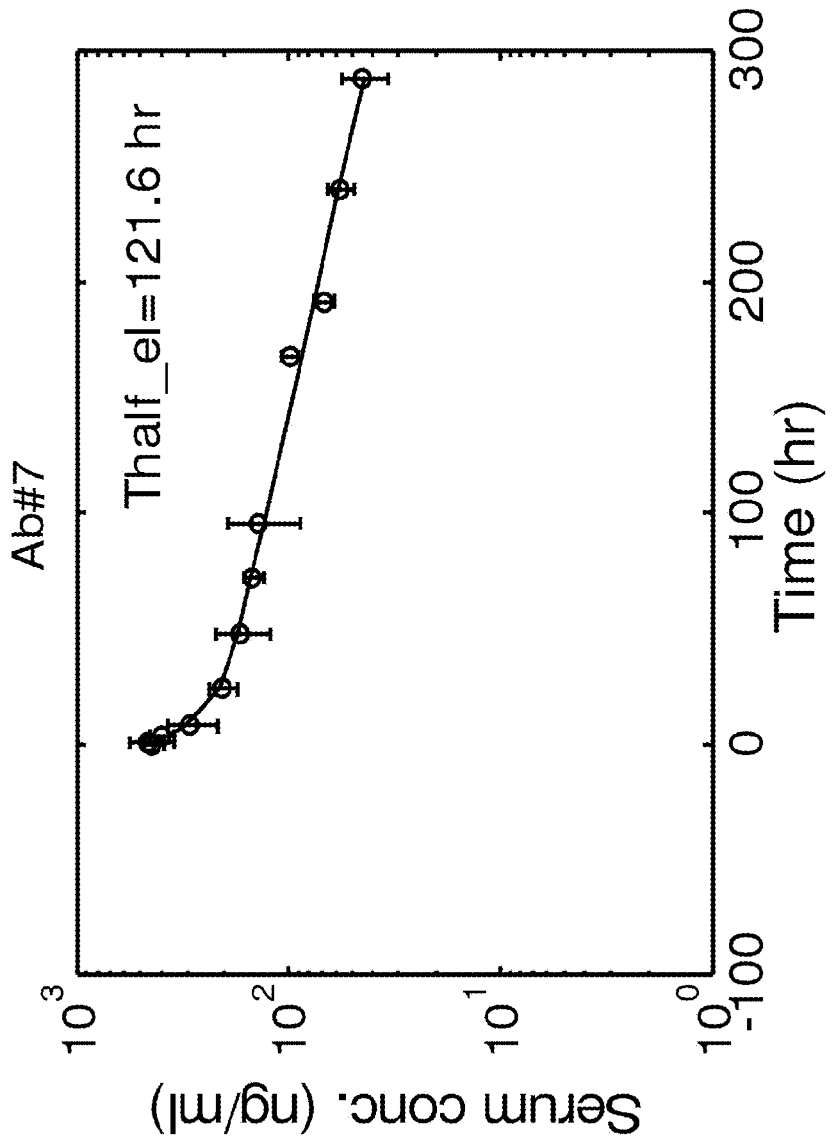
FIG. 30B: Murine pharmacokinetics—terminal half life of anti-c-Met/anti-EpCam Tandem Fc Bispecific Antibody Ab#7.
Figure 30C:
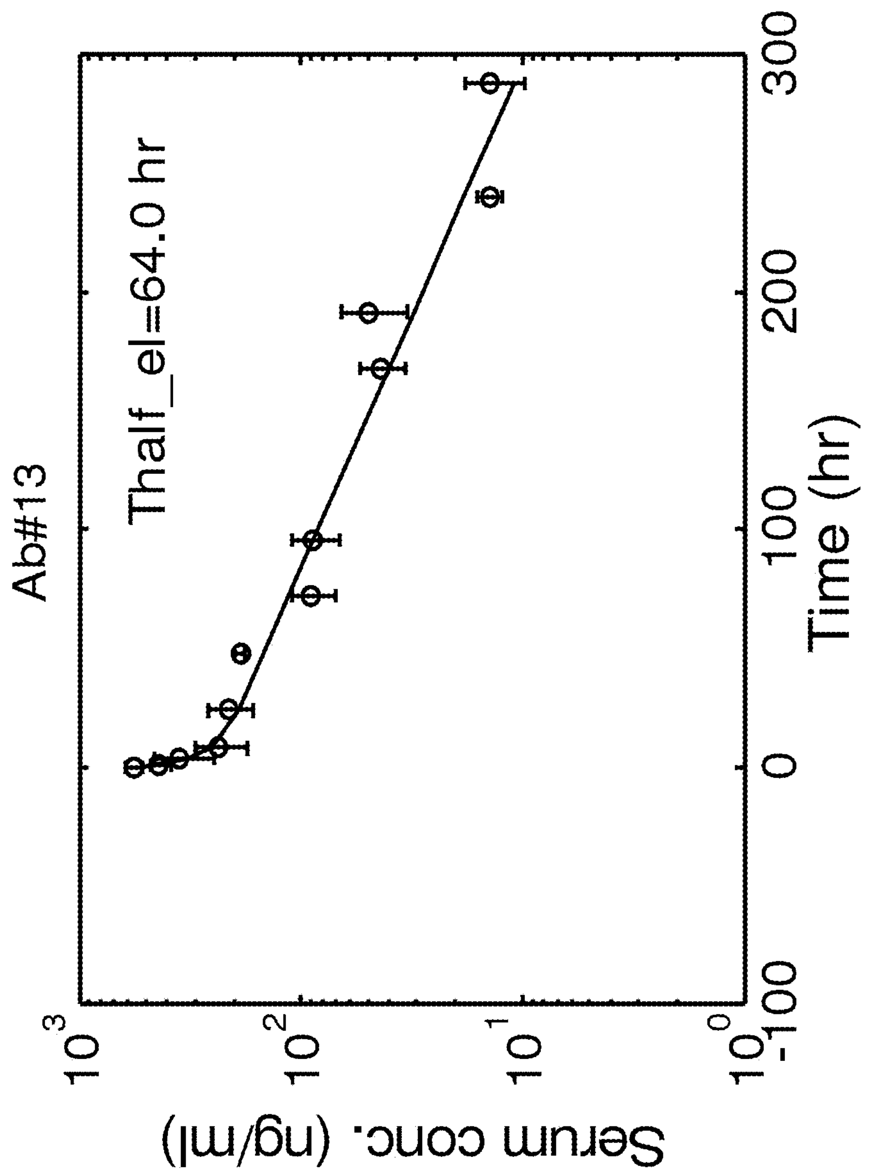
FIG. 30C: Murine pharmacokinetics—terminal half life of anti-c-Met/anti-EpCam Tandem Fc Bispecific Antibody Ab#13.

Using the above methods, OA-5D5, Ab#5, Ab#7, and Ab#13 were assessed for the ability to simultaneously bind both c-Met and EpCAM. Representative results of the assay are shown in FIG. 22. The three bispecific antibodies tested both exhibited a dose-dependent increase in absorbance, confirming ability to bind both recombinant c-Met and EpCAM, whereas monospecific control antibody showed no significant signal in the assay.

Example A-7

Quantitative Flow Cytometry Assessment for Cell Surface Expression of c-Met and EpCAM For measurements of cell surface expression of, e.g., cMet and EpCAM levels, quantitative flow cytometry is performed using the Quantum Simply Cellular kit (Bangs Laboratories).

Cells are grown in exponential phase using standard cell culture media containing 10% FBS, and are passaged at least twice before the start of the experiment. On the day of the experiment, cells are visually assessed under a microscope to confirm between 60% and 80% confluence. Cells are detached from the culture plate by addition of 20 μl trypsin, and once a majority of cells are detached (as assessed visually by microscope) the trypsin is inactivated using cell culture media containing 10% FBS. The cells are centrifuged at 500 g, resuspended in flow cytometry buffer (2% FBS+0.1% sodium azide in PBS), and seeded at a density of 50,000 cells per well in a 96-well plate (BD Biosciences, catalog #62406-015).

In a separate 96-well plate, 2 drops of Quantum Simply Cellular anti-mouse IgG coated beads (Bangs Laboratories, catalog #815) or anti-human IgG coated beads (Bangs Laboratories, catalog #816) are added per well. Each bead kit contains 5 bead populations (1 blank and 4 beads with increasing levels of Fc-specific capture antibody). Each coated population binds a specific number of monoclonal antibodies of the appropriate species (the "ABC" value), and thus serves as a standard curve for quantification when beads are labeled to saturation with the same monoclonal antibody that is used to label cell surface protein.

Anti-cMet human antibody (h224G11-TH7 clone) or anti-EpCAM murine antibody (BD Biosciences, catalog #347200) conjugated with APC are added to the cells and the beads (200 nM antibody concentration in 80 μl of flow cytometry buffer). Antibody is allowed to incubate for 30 minutes at 4° C. The plates are centrifuged and washed twice with 100 μL of ice-cold flow cytometry buffer. After the last wash, the cells and beads are centrifuged and resuspended in 100 μL of ice-cold flow cytometry buffer and read using the appropriate fluorescence filter on a flow cytometer (BD FACSCanto). Channel values for the bead populations are recorded in the bead lot-specific QuickCal template provided in the Quantum Simply Cellular kit. A regression is performed that relates fluorescence signal to the beads' ABC values. ABC values are assigned to stained cell samples using this standard curve. If monovalent antibody-to-cell surface receptor binding is presumed, then the ABC value equals the number of surface receptors.

Table 5 lists EpCAM and c-Met cell surface expression levels in cell lines measured using the above protocol. U-87 MG and A549 cells have low EpCAM expression level, which NCI-H441, HCC827, and NCI-H2170 cells have high levels of EpCAM expression.

TABLE A-5

| Cell line | c-Met (#/cell) | EpCAM (#/cell) | EpCAM:c-Met ratio |
|---|---|---|---|
| U-87 MG | $3.2 \times 10^4$ | $4.0 \times 10^2$ | $1.3 \times 10^{-2}$ |
| A549 | $7.2 \times 10^4$ | $2.4 \times 10^4$ | $3.3 \times 10^{-1}$ |
| NCI-H441 | $3.2 \times 10^5$ | $2.5 \times 10^6$ | $7.8 \times 10^0$ |
| HCC827 | $2.1 \times 10^5$ | $2.1 \times 10^6$ | $1.0 \times 10^1$ |
| NCI-H2170 | $5.8 \times 10^4$ | $3.9 \times 10^6$ | $6.7 \times 10^1$ |

Example A-8

Assessment of Basal c-Met Pathway Activation

A) Antibody-Induced Activation of c-Met Mediated Cell Signaling

Activation of c-Met pathway signaling is an observable characteristic of bivalent antibodies against c-Met. The ability of the antibodies to activate c-Met mediated signal transduction can be assessed using a phospho-c-Met ("pMet") enzyme-linked immunosorbent assay (ELISA), essentially as follows.

On Day 1 of the experiment, A549 cells actively growing in mid-log phase (60-80% confluence) are plated at approximately 20,000 cells per well in a 96-well plate using RPMI media containing 10% FBS and supplemented with penicillin/streptomycin and 2 mM 1-glutamine. On Day 2, the media is aspirated and replaced with low-serum RPMI media containing 0.5% FBS and supplemented with penicillin/streptomycin and 1-glutamine, and the cells incubated overnight. On Day 3, dilution series of both HGF (serving as positive control, with starting concentration of 40 nM diluted serially 3-fold) and antibodies (with starting concentration of 300 nM diluted serially 3-fold) are prepared using low-serum media. 100 μL from each dilution series concentration is then added to a plate well, and the cells are allowed to incubate at 37° C. for 10 minutes. Cells are then washed 2× with cold PBS and lysed in 50 μL per well of M-PER solution (catalog #PI78505, VWR International)+150 mM NaCl+protease and phosphatase inhibitor (cOmplete Protease Inhibitor Cocktail Tablet provided in EASY packs, catalog #4693124001, Roche Diagnostics Corp; PhosSTOP Phosphatase Inhibitor Cocktail Tablets, catalog #4906837001, Roche Diagnostics Corp). Cell lysates are stored at −80° C. within approximately 5 minutes after lysis.

For measurement of pMet signal, an ELISA kit is used (Human Phospho-HGF R/c-MET DuoSet IC Economy Pack, catalog #DYC2480E, R&D Systems). On Day 3, a 384-well High Binding Black Solid plate (Corning) is coated with capture anti-c-Met antibody at a final concentration of 4 μg per ml in 20 μl per well of PBS. The plates are left at overnight at room temperature. On Day 4, the −80° C. lysate is thawed at room temperature. The 384-well plates are blocked with 50 μL per well of a solution of 2% BSA in PBS for 1 hour at room temperature. Duplicate lysates are pooled into one well and diluted 2-fold in a solution of 2% BSA/0.1% Tween-20/25% M-PER/PBS. A standard curve of recombinant pMet is prepared by making a series of ten 2-fold serial dilutions (starting at 40 nM concentration) in 2% BSA/0.1% Tween-20/25% M-PER/PBS. Wells containing buffer only are used as control for background signal on the plate. ELISA plates are washed with a solution of 0.05% Tween-20 in PBS, and 20 μL of lysate or recombinant standard curve is transferred from the 96-well plate in duplicate to the 384-well plate. Plates are incubated at room temperature for 2 hours and washed with a solution of 0.05% Tween-20 in PBS. Next, 20 μL of primary detection antibody conjugated with horseradish peroxidase is added per well to the ELISA plates and incubated for 2 hours at room temperature. SuperSignal ELISA Pico Chemiluminescent Substrate (catalog #PI37069, VWR International) is added per manufacturer's directions and read on an Envision Plate Reader (Perkin Elmer). For data analyses, the duplicate samples are averaged and error bars are used to represent the standard deviation between the two replicates. Data are background-subtracted and regressed against the recombinant standard curve. Subsequently, Met stimulation curves and corresponding EC50 values are calculated using GraphPad Prism software (GraphPad Software, Inc.) via regression of the data to a 4-parameter logistic equation.

Using the above protocol, antibody-induced activation of Met to yield phospho-Met (pMet) was tested for a bivalent IgG. The result of this experiment is shown in FIG. 6. Treatment with HGF, as expected, produced a strong pMet signal. Bivalent IgG treatment also caused c-Met phosphorylation, to a level roughly one-half that of the native c-Met ligand HGF. In contrast, monovalent antibody OA-5D5 did not cause c-Met phosphorylation.

Ab#5, Ab#7, Ab#13, and OA-5D5 were subsequently tested in the above assay for their ability to cause c-Met phosphorylation. The results of this experiment are shown in FIG. 7. Again, treatment of HGF resulted in a strong pMet dose-response signal, while monovalent antibody OA-5D5 did not cause c-Met phosphorylation. Treatment with the bispecific antibodies did not result in c-Met phosphorylation.

B) Antibody-Induced Activation of Cell Proliferation

Antibodies targeting the c-Met receptor often have the ability to stimulate DNA synthesis and cell proliferation, which is detrimental for the development of a drug targeting human malignancies. This property can be assessed as follows.

For determination of the ability of the antibodies to induce cell proliferation, cells are first plated in a 384-well plate using 50 μl of RPMI Media 1640 (Gibco) containing 0.5% FBS. A549 cells are plated at 800 cells per well, NCI-H441 cells are plated at 2500 cells per well, and HCC827 cells are plated at 1500 cells per well. After overnight incubation of the plate, media is aspirated and replaced with 50 μl of RPMI Media 1640 containing 0.5% FBS and either 2.5 nM HGF alone as a positive control, or 500 nM of the antibody of interest. The plate is then incubated at 37° C., and cell growth monitored using an Incucyte real-time imaging system (Essen Bioscience). Images of the plate wells are recorded using phase contrast microscopy every six hours for four days, and cell confluence (reported as a percentage) calculated according to manufacturer's software. Confluence data is exported into GraphPad Prism software (GraphPad Software, Inc.) for plotting and visualization.

Using the above experimental protocol, Ab#5, Ab#7, and Ab#13 were tested in A549, NCI-H441, and HCC827 cells. Data from these experiments are plotted in FIG. 8A (A549 cells), FIG. 8B (NCI-H441 cells), and FIG. 8C(HCC827 cells). Each data point shown represents the mean confluence of cells in four replicate plate wells. For all three cell lines, HGF stimulation resulted in increased confluence of cells relative to the low serum control, corresponding to an increase in cell proliferation. In NCI-H441 and HCC827 cells, none of the tested bispecific antibodies resulted in greater cell confluence than the low serum control. In A549 cells, Ab#7 and Ab#13 showed no increase of cell confluence above the low serum control, while Ab#5 modestly increased cell confluence above the low serum control.

Example A-9

Assessment of Inhibition of HGF-Induced c-Met Pathway Activation

A) Antibody-Mediated Inhibition of HGF-Induced Cell Signaling

The ability of antibodies to inhibit HGF-induced, c-Met mediated signal transduction may be assessed in A549 and NCI-H2170 cells using a phospho-AKT ("pAKT") ELISA. On Day 1 of the experiment, cells actively growing in mid-log phase (60-80% confluence) are plated at approximately 20,000 cells per well in a 96-well plate using RPMI media (+10% FBS+2 mM L-glutamine+Pen/Strep). On Day 2, the media is aspirated and replaced with low-serum RPMI media (+0.5% FBS+L-glutamine+Pen/Strep), and the cells incubated overnight. On Day 3, dilution series of antibodies (with starting concentration of 300 nM diluted serially 3-fold) are prepared using low-serum media. 100 μL from each dilution series concentration is then added to a plate well, and the cells are allowed to incubate at 37° C. for 2 hours. Next, the antibody containing media is aspirated and replaced with 100 μL of antibody containing media additionally containing 1 nM HGF. The cells are allowed to incubate with the HGF containing media at 37° C. for 10 minutes. Cells are then washed 2× with cold PBS and lysed in 50 μL per well of M-PER solution (catalog #PI78505, VWR International)+150 mM NaCl+protease and phosphatase inhibitor (cOmplete Protease Inhibitor Cocktail Tablet provided in EASY packs, catalog #4693124001, Roche Diagnostics Corp; PhosSTOP Phosphatase Inhibitor Cocktail Tablets, catalog #4906837001, Roche Diagnostics Corp). Cell lysates are stored at −80° C. within approximately 5 minutes after lysis.

For measurement of pAKT signal, an ELISA assay was used. A 384-well High Binding Black Solid plate (Corning) is coated with capture anti-AKT antibody (Millipore, catalog #05-591M) at a final concentration of 4 μg per ml in 20 μl per well of PBS. The plates are left at overnight at room temperature. On Day 4, the −80° C. lysate is thawed at room temperature. The 384-well plates are blocked with 50 μL per well of a solution of 2% BSA in PBS for 1 hour at room temperature. Duplicate lysates are pooled into one well and diluted 2-fold in a solution of 2% BSA/0.1% Tween-20/25% M-PER/PBS. A standard curve of recombinant pAKT (Millipore, catalog #14-276) is prepared by making a series of ten 2-fold serial dilutions (starting at 60 nM concentration) in 2% BSA/0.1% Tween-20/25% M-PER/PBS. Wells containing buffer only are used as control for background signal on the plate. ELISA plates are washed with a solution of 0.05% Tween-20 in PBS, and 20 μL of lysate or recombinant standard curve is transferred from the 96-well plate in duplicate to the 384-well plate. Plates are incubated at room temperature for 2 hours and washed with a solution of 0.05% Tween-20 in PBS. Next, 20 μL of 1:1000 diluted biotinylated secondary antibody (Cell Signaling Technology, catalog #5102) is added per well to the ELISA plates and incubated for 1 hr at room temperature. ELISA plates are then washed with a solution of 0.05% Tween-20 in PBS. 20 μL of diluted streptavidin conjugated with HRP (R&D Systems, catalog #DY998) is added to the ELISA plates and incubated for 30 minutes at room temperature. SuperSignal ELISA Pico Chemiluminescent Substrate (catalog #PI37069, VWR International) is added per manufacturer's directions and read on an Envision Plate Reader (Perkin Elmer). For data analyses, the duplicate samples are averaged and error bars are used to represent the standard deviation between the two replicates. Data are background-subtracted and regressed against the recombinant standard curve. Subsequently, pAKT inhibition curves and corresponding $IC_{50}$ values are calculated using GraphPad Prism software (GraphPad Software, Inc.) via regression of the data to a 4 parameter logistic equation.

Using the above protocol, the ability of Ab#5, Ab#7, Ab#13, and OA-5D5 to inhibit HGF stimulated pAKT was tested in both A549 and NCI-H2170 cells. Typical results of these experiments are shown in FIG. 9. In the A549 cells, which have low EpCAM expression, Ab#5, Ab#7, and Ab#13 had substantially equivalent inhibition potency relative to OA-5D5. In the NCI-H2170 cells, which have high EpCAM expression, Ab#5, Ab#7, and Ab#13 exhibited approximately a 10-fold to 20-fold improvement in pAKT IC50 relative to OA-5D5.

B) Antibody-Mediated Inhibition of HGF-Induced Cell Proliferation

The ability of antibodies to inhibit HGF-induced, c-Met mediated cell proliferation may be assessed, for example, in U-87 MG, A549, and NCI-H441 cells as follows.

For determination of the ability of the antibodies to inhibit HGF-induced, c-Met mediated cell proliferation, cells are first plated in a 384-well plate using 50 μl of RPMI Media 1640 (Gibco) containing 0.5% FBS. A549 cells are plated at 800 cells per well, U-87 MG cells are plated at 1500 cells per well, and NCI-H441 cells are plated at 3000 cells per well.

For A549 and NCI-H441 cells, after overnight incubation of the plate, media is aspirated and replaced with 50 μl of RPMI Media 1640 containing 0.5% FBS only (negative control), 0.5% FBS plus 0.625 nM HGF (positive control), or 0.5% FBS plus 0.625 nM HGF and 500 nM of the antibody of interest.

For U-87 MG cells, which secrete autocrine HGF, after overnight incubation of the plate, media is aspirated and replaced with 50 μl of RPMI Media 1640 containing either 0.5% FBS only (negative control) or 0.5% FBS plus 500 nM of the antibody of interest.

The plate is then incubated at 37° C., and cell growth monitored using an Incucyte real-time imaging system (Essen Bioscience). Images of the plate wells are recorded using phase contrast microscopy every six hours for four days, and cell confluence (reported as a percentage) calculated according to manufacturer's software. Confluence data is exported into GraphPad Prism software (GraphPad Software, Inc.) for plotting and visualization.

Using the above experimental protocol, Ab#5 and OA-5D5 were tested using U-87 MG and NCI-H441 cells. Results from a representative experiment are plotted in FIG. 10. Each data point shown represents the mean confluence of cells in four replicate plate wells. In the U-87 MG cells, which have low EpCAM expression, both Ab#5 and OA-5D5 were substantially equivalently able to decrease cell confluence. In the NCI-H441 cells, which have high EpCAM expression, Ab#5 but not OA-5D5 exhibited an ability to decrease HGF-induced cell confluence below basal 0.5% serum conditions.

Using the above experimental protocol, Ab#7 and OA-5D5 were tested using A549 and NCI-H441 cells. Results from a representative experiment are plotted in FIG. 11. Each data point shown represents the mean confluence of cells in four replicate plate wells. In the A549 cells, which have low EpCAM expression, both Ab#7 and OA-5D5 were able to inhibit HGF-induced cell confluence to the level of the 0.5% serum control. In the NCI-H441 cells, which have high EpCAM expression, Ab#5 decreased cell confluence nearly to the basal 0.5% serum control, while OA-5D5 showed a decreased ability to inhibit cell confluence.

Example A-10

Assessment of Antibody-Induced c-Met Degradation

To assess the ability of antibodies to induce degradation of c-Met receptor, 7,000 A549 or 15,000 NCI-H2170 cells are plated into a 96-well flat bottom plate using RPMI media containing 10% FBS and supplemented with penicillin/streptomycin and 1-glutamine. The following day, media is replaced with 100 μl of low-serum RPMI 1640 media (Gibco) containing 0.5% FBS supplemented with penicillin/streptomycin and 1-glutamine. After overnight incubation, the low-serum media is aspirated and replaced with low-serum media additionally containing the antibody of interest. Cells are incubated at 37° C., 5% CO2 for 24 hours. Upon the completion of the 24 hour incubation, the cells are washed with PBS twice and then lysed with M-PER (mammalian protein extraction reagent; Pierce, catalog #78505) containing protease and phosphatase inhibitors (cOmplete, Mini, EDTA-free Protease Inhibitor Cocktail Tablet provided in EASY packs, catalog #04693159001, Roche Diagnostics Corp; PhosSTOP Phosphatase Inhibitor Cocktail Tablets, catalog #4906837001, Roche Diagnostics Corp).

Cell lysates are evaluated in duplicate by a total c-Met ELISA (Invitrogen, catalog #KH00251) according to the manufacturer's instructions. Signal was detected using an Envision Plate Reader (Perkin Elmer). For each cell line, the total c-Met expression was normalized to the amount detected in a no inhibitor media control to allow for comparison across cell lines.

Using the above method, OA-5D5 and Ab#5 were tested for the ability to degrade c-Met receptor in A549 and H2170 cells. The resulting data is shown in FIG. 12. In the low EpCAM A549 cells, neither OA-5D5 nor Ab#5 induced more than 20% c-Met degradation. In the high EpCAM NCI-H2170 cells, OA-5D5 reduced c-Met expression by approximately 30%, while Ab#5 reduced c-Met expression by approximately 65%.

Example A-11

Pharmacokinetic Properties of Antibodies in Mice

To determine the terminal elimination half-life of the antibodies, Nu/Nu mice (Charles River Laboratories) are dosed by intravenous bolus with antibody, and bleeds taken at 0.25, 1, 4, 8, 24, 48, 72, 96, 144, 192, 240, and 288 hours. Three mice are bled per time point (using either saphenous vein or terminal bled) and the serum collected (between 10-200 μl) from individual animals. For serum sample analysis, Reacti-Bind 96-well plates (Pierce) are coated with 50 μl of 1 μg/ml of goat anti-Fc antibody (Abcam, catalog #ab98616) in PBS and incubated overnight at 4° C. On the next day, plates are washed with PBS-T (PBS+0.05% Tween-20), blocked for 1 hour at room temperature with 100 μl of Protein-Free Blocking Buffer (Pierce, catalog #37572), and washed again with PBS-T. The plates are then incubated for 2 hours at room temperature with 100 μL of samples and standard curves. For the standard curves, antibodies of interest are diluted to an initial concentration of 12 μg/ml in PBS-T with 10 additional 3-fold dilutions and a final well blank. Serum samples are diluted at 1:50 in PBS-T with 10 additional 3-fold dilutions and a final well blank. The plates are washed with PBS-T, and 100 μl of anti-Fc-HRP antibody (Abcam, catalog #ab99759; 1:20,000 in PBS-T) is added and incubated (covered) for 1 hour at room temperature. Plates are again washed with PBS-T, followed by addition of 100 μl of 3,3',5,5'-tetramethylbenzidine (TMB; Cell Signaling, catalog #7004) and incubation between 5-15 minutes at room temperature. The substrate reaction is stopped with 100 μl of Stop Solution (Cell Signaling, catalog #7002). The well absorbance is measured at 450 nm using an Envision plate reader (PerkinElmer), and the back-calculated values generated using SoftMax Pro.

Pharmacokinetic curve fitting is performed in MATLAB (The Mathworks) using non-linear regression analysis of a two-compartment biexponential model:

$$\text{Concentration}=Ae^{-\alpha t}+Be^{-\beta t}$$

For the non-linear regression, data is assumed to follow a proportional error model, and thus for the regression the model and data are weighted using the inverse of data magnitude. Terminal elimination half-life is calculated as follows:

$$t_{\frac{1}{2},el} = \frac{\ln(2)}{\beta}$$

Figure 13B:
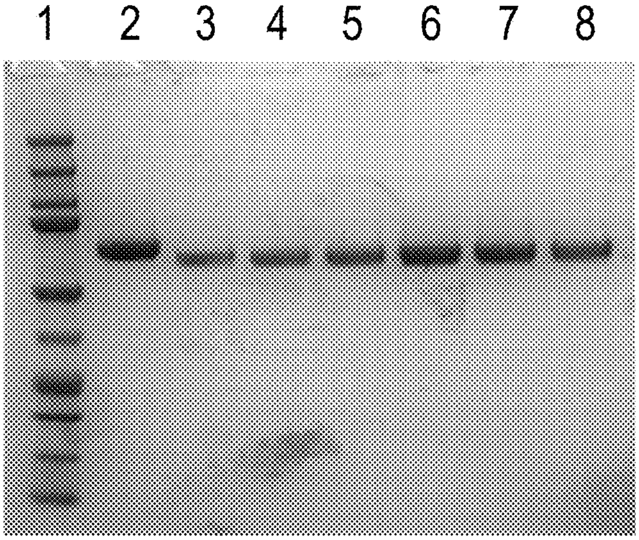
FIG. 13B: Reduced SDS-PAGE of charged glycosylation mutants: Lane 1=size standards, Lanes 2-8; 2=glyco wt, 3=glyco 1, 4=glyco 2, 5=glyco 3, 6=glyco 4, 7=glyco 5, 8=glyco 6.

Ab#5, Ab#7, and Ab#13 were evaluated using the above methods, and the resulting mean and standard deviation (6 data points for each timepoint representing 3 mice and 2 well replicates per mouse) are plotted in FIG. 13A (Ab#5), FIG. 13B (Ab#7), and FIG. 13C (Ab#13). Model fits to the data are shown as a solid line. Terminal half-life data is given below in Table 6.

TABLE A-6

| Antibody | Dose (mg/kg) | Terminal elimination half-life (hr) |
|---|---|---|
| Ab#5 | 30 | 60 |
| Ab#7 | 30 | 121 |
| Ab#13 | 30 | 64 |

Example A-12

Evaluation of Antibody Activity on U-87 MG Tumors Implanted into Nude Mice

The in vivo activity of Ab#7 and OA-5D5 is evaluated as follows. Six-to-seven-week-old female Nu/Nu mice (Charles River Laboratories) are injected subcutaneously with $5\times10^6$ U-87 MG cells/mouse (ATCC) using an injection volume of 200 μl PBS. Seven days post-injection, initial tumor volumes are measured using the following formula: $(\pi/6)*L*W^2$. Mice are segregated into groups of 10, and subsequently treated with PBS control, bispecific antibody, or OA-5D5 by intraperitoneal injection every 3 days. The doses of the bispecific antibody correspond to approximately 30 mg/kg based on body weight, while the doses of OA-5D5 dosing were approximately 24 mg/kg (an equal molar level). Tumor measurements are determined twice weekly throughout the study. Plotted data of tumor size represents mean and standard error of the mean for each measurement.

Figure 31:
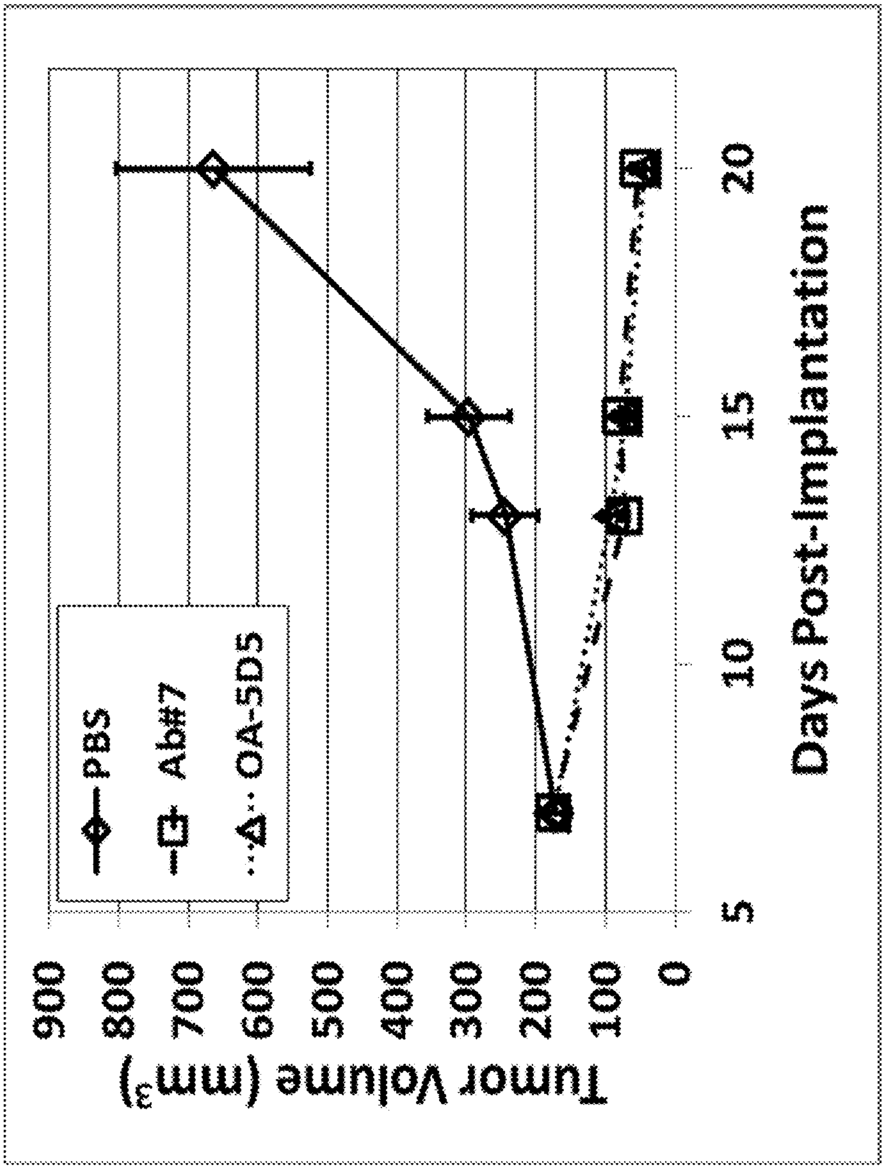
FIG. 31: illustrates the results of testing the effect of an agent on tumor volume over time. Anti-c-Met/anti-EpCam Tandem Fc Bispecific Antibody Ab#7 and monovalent anti-c-Met antibody OA-5D5 each reduce U87 MG cell xenograft tumor growth in nude mice and cause tumor regression. Both Ab#7 and OA-5D5 were able to demonstrate regression of subcutaneously implanted U-87 MG tumors to a similar extent.

Data from a representative experiment using the above protocol are shown in FIG. 31. Both Ab#7 and OA-5D5 were able to regress subcutaneously implanted U-87 MG tumors to a similar extent.

Example A-13

Sequence Information for Additional Embodiments

```
Amino Acid (aa) and Nucleotide (nt) sequences

Underline: CDRs

Bold sequence: Stabilization mutations

>anti-c-Met-LC aa (Light Chain for SEQ ID NOs: 403-415)
                                                            (SEQ ID NO: 400)
DIQMTQSPSSVSASVGDRVTITCRASQGISSWLAWYQQKPGKAPKLLIYAASSLQSGVPSRFSGSGSGTDFTLT

ISS
                                CDR1                     CDR2

LQPEDFATYYCLQANSFPPTFGGGTKVEIKRTVAAPSVFIFPPSDEQLKSGTASVVCLLNNFYPREAKVQWKVD

NAL
              CDR3

QSGNSQESVTEQDSKDSTYSLSSTLTLSKADYEKHKVYACEVTHQGLSSPVTKSFNRGEC**

>RESERVED SEQUENCE
                                                            (SEQ ID NO: 401)
XXXX

>anti-c-Met-LC nt (Light Chain for SEQ ID NOs: 403-415)
                                                            (SEQ ID NO: 402)
gacattcagatgacccagtctccttcaagcgtcagcgcttccgtgggcgaccgggtcaccatcacatgcagagc

ctcccaggggattagctcctggctggcttggtatcagcagaagcctgggaaagcaccaaagctgctgatctatg

ccgcttctagtctgcagtccggagtgccctctcgattctctggcagtgggtcaggaaccgactttactctgacc

atttcaagcctgcagcctgaggatttcgctacatactattgcctgcaggcaaactctttccccccctacctttgg

cggggggaacaaaagtggagatcaagcgtacggtggcagccccatccgtcttcatttttccaccctctgacgaac

agctgaaaagtggcacagccagcgtggtctgtctgctgaacaatttttacccccgcgaagccaaagtgcagtgg

aaggtcgataacgctctgcagagcgggaattcccaggagtctgtgactgaacaggacagtaaagattcaaccta

tagcctgtcctctacactgactctgagcaaggcagattacgagaagcacaaagtgtatgcctgcgaagtcacac

atcagggactgagttcacctgtgactaagagcttcaatagaggcgagtgttgataa

>Ab#1-HC-aa
                                                            (SEQ ID NO: 403)
QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGS
```

-continued

DIVMTQSPLSLPVTPGEPASISCRSTKSLLHSNGITYLYWYLQKPGQSPQLLIYQMSNLASGVPDRFSSSGSGT
DFTLKISRVEAEDEGVYYCAQNLEIPRTFGGGTKLEIKRTGGGGSGGGGSGGGGSGGGGSQVQLVQSGAEVKKP
GESVKISCKASGYTFTNYGMNWVRQAPGQGLKWMGWINTYTGESTYADDFKGRFAFSLDTSASTAYLQLSSLRS
EDTAVYFCARFAIKGDYWGQGTLVTVSS**

>Ab#2-HC-aa (SEQ ID NO: 404)

QLQLQESGPGLVKPSETLSLTCTVSGGSISSSVYYWSWIRQPPGKGLEWIGVIYPSGNTYYSPSLKSRVTISVD
TSKNQFSLKLSSVTAADTAVYYCARTIYDLFDIWGQGTMVTVSSASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCD
KTHTCPSCPAPEFLGGPSVFLFPPKPKDTLMISRTPEVTCVVVDVSQEDPEVQFNWYVDGVEVHNAKTKPREEQ
FNSKYRVVSVLTVLHQDWLNGKEYKCKVSNKGLPSSIEKTISKAKGQPREPQVYTLPPSREEMTKNQVSLSCAV
KGFYPSDIAVEWESNGQPENNYKTTPPVLDSDGSFFLVSKLTVDKSRWQQGNVFSCSVMHEALHNHYTQKSLSL
SKSCDKTGGGGSGGGGSGGGGSGGGGSGGGGSGGGGSGGGGSGGGGSCPSCPAPEFLGGPSVFLFPPKPKDTLM
ISRTPEVTCVVVDVSQEDPEVQFNWYVDGVEVHNAKTKPREEQFNSDYRVVSVLTVLHQDWLNGKEYKCKVSNK
GLPSSIEKTISKAKGQPREPQVYTLPPSREEMTKNQVSLWCLVKGFYPSDIAVEWESNGQPENNYKTTPPVLDS
DGSFFLYSKLTVDKSRWQQGNVFSCSVMHEALHNHYTQKSLSLSGECGGGGSGGGGS
QVQLVQSGSELKKPGESVKVSCKASGYTFTNYGMHWVRQAPGQGLKWMGWINTYTGESTYADDFKGRFAFSLDT
SASTAYLQISSLKAEDTAVYFCARFAIKGDYWGQGTLVTVSSASTGGGGSGGGGSGGGGSGGGGSDIVMTQSPL
SLPVTPGEPASISCRSTKSLLHSDGITYLYWYLQKPGQSPQLLIYQLSNLASGVPDRFSSSGSGTDFTLKISRV
EAEDEGVYYCAQNLEIPYTFGQGTKVEIK**

>Ab#3-HC-aa (SEQ ID NO: 405)

QLQLQESGPGLVKPSETLSLTCTVSGGSISSSVYYWSWIRQPPGKGLEWIGVIYPSGNTYYSPSLKSRVTISVD
TSKNQFSLKLSSVTAADTAVYYCARTIYDLFDIWGQGTMVTVSSASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCD
KTHTCPSCPAPEFLGGPSVFLFPPKPKDTLMISRTPEVTCVVVDVSQEDPEVQFNWYVDGVEVHNAKTKPREEQ
FNSKYRVVSVLTVLHQDWLNGKEYKCKVSNKGLPSSIEKTISKAKGQPREPQVYTLPPSREEMTKNQVSLSCAV
KGFYPSDIAVEWESNGQPENNYKTTPPVLDSDGSFFLVSKLTVDKSRWQQGNVFSCSVMHEALHNHYTQKSLSL
SKSCDKTGGGGSGGGGSGGGGSGGGGSGGGGSGGGGSGGGGSGGGGSCPSCPAPEFLGGPSVFLFPPKPKDTLM
ISRTPEVTCVVVDVSQEDPEVQFNWYVDGVEVHNAKTKPREEQFNSDYRVVSVLTVLHQDWLNGKEYKCKVSNK
GLPSSIEKTISKAKGQPREPQVYTLPPSREEMTKNQVSLWCLVKGFYPSDIAVEWESNGQPENNYKTTPPVLDS
DGSFFLYSKLTVDKSRWQQGNVFSCSVMHEALHNHYTQKSLSLSGECGGGGSGGGGS
QVQLVQSGSELKKPGESVKVSCKASGYTFTNYGMNWVRQAPGQGLKWMGWINTYTGESTYADDFKGRFAFSLDT
SASTAYLQISSLKAEDTAVYFCARFAIKGDYWGQGTLVTVSSASTGGGGSGGGGSGGGGSGGGGSDIVMTQSPL
SLPVTPGEPASISCRSTKSLLHSDGITYLYWYLQKPGQSPQLLIYQLSNLASGVPDRFSSSGSGTDFTLKISRV
EAEDEGVYYCAQNLEIPRTFGQGTKVEIK**

>Ab#4-HC-aa (SEQ ID NO: 406)

QLQLQESGPGLVKPSETLSLTCTVSGGSISSSVYYWSWIRQPPGKGLEWIGVIYPSGNTYYSPSLKSRVTISVD
TSKNQFSLKLSSVTAADTAVYYCARTIYDLFDIWGQGTMVTVSSASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCD
KTHTCPSCPAPEFLGGPSVFLFPPKPKDTLMISRTPEVTCVVVDVSQEDPEVQFNWYVDGVEVHNAKTKPREEQ
FNSKYRVVSVLTVLHQDWLNGKEYKCKVSNKGLPSSIEKTISKAKGQPREPQVYTLPPSREEMTKNQVSLSCAV
KGFYPSDIAVEWESNGQPENNYKTTPPVLDSDGSFFLVSKLTVDKSRWQQGNVFSCSVMHEALHNHYTQKSLSL

-continued

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGS

DIVMTQSPLSLPVTPGEPASISCRSTKSLLHSDGITYLYWYLQKPGQSPQLLIYQLSNLASGVPDRFSSSGSGT

DFTLKISRVEAEDEGVYYCAQNLEIPRTFGQGTKVEIKRTGGGGSGGGGSGGGGSGGGGSGQVQLVQSGSELKK

PGESVKVSCKASGYTFTNYGMNWVRQAPGQGLKWMGWINTYTGESTYADDFKGRFAFSLDTSASTAYLQISSLK

AEDTAVYFCARFAIKGDYWGQGTLVTVSS**

>Ab#5-HC-aa (SEQ ID NO: 407)

QLQLQESGPGLVKPSETLSLTCTVSGGSISSSVYYWSWIRQPPGKGLEWIGVIYPSGNTYYSPSLKSRVTISVD

TSK

CDR1 CDR2

NQFSLKLSSVTAADTAVYYCARTIIYDLFDIWGQGTMVTVSSASTKGPSVFPLAPSSKSTSGGTAALGCLVKDYF

PEP

CDR3

VTVSWNSGALTSGVHTFPAVLQSSGLYSLSSVVTVPSSSLGTQTYICNVNHKPSNTKVDKKVEPKSCDKTHTCP

SCPAPEFLGGPSVFLFPPKPKDTLMISRTPEVTCVVVDVSQEDPEVQFNWYVDGVEVHNAKTKPREEQFNSKYR

VVSVLTVLHQDWLNGKEYKCKVSNKGLPSSIEKTISKAKGQPREPQVYTLPPSREEMTKNQVSLSCAVKGFYPS

DIAVEWESNGQPENNYKTTPPVLDSDGSFFLVSKLTVDKSRWQQGNVFSCSVMHEALHNHYTQKSLSLSKSCDK

TGGGGSGGGGSGGGGSGGGGSGGGGSGGGGSGGGGSGGGGSCPSCPAPEFLGGPSVFLFPPKPKDTLMISRTPE

VTCVVVDVSQEDPEVQFNWYVDGVEVHNAKTKPREEQFNSDYRVVSVLTVLHQDWLNGKEYKCKVSNKGLPSSI

EKTISKAKGQPREPQVYTLPPSREEMTKNQVSLWCLVKGFYPSDIAVEWESNGQPENNYKTTPPVLDSDGSFFL

YSKLTVDKSRWQQGNVFSCSVMHEALHNHYTQKSLSLSGECGGGGSGGGGSDIVMTQSPLSLPVTPGEPASISC

RSTKSLLHSNGITYLYWYLQKPGQ

CDR4

SPQLLIYQMSNLASGVPDRFSSSGSGTDFTLKISRVEAEDEGVYYCAQNLEIPRTFGGGTKLEIKRTGGGGSGG

GGS

CDR5 CDR6

GGGGSGGGGSQVQLVQSGAEVKKPGESVKISCKASGYTFTNYGMNWVRQAPGQGLKWMGWINTYTGESTYADDF

KGR

CDR7 CDR8

FAFSLDTSASTAYLQLSSLRSEDTAVYFCARFAIKGDYWGQGTLVTVSS**

CDR9

>Ab#5-HC-nt (SEQ ID NO: 408)

cagctgcagctgcaggagagcggacccggactggtcaagccctccgagacactgtctctgacctgcacagtgtc aggcgggagcatcagctcctctgtctactattggtcttggattcggcagcccccctggaaagggcctggaatgga tcggcgtgatctacccaagtgggaacacttactattctcccagtctgaaatccagagtgaccatcagtgtcgac acatcaaagaatcagttcagcctgaaactgagttcagtgacagccgctgatactgcagtctactattgtgccag gaccatctatgacctgtttgatatttgggggcagggaactatggtgaccgtcagctccgctagcactaagggac cttccgtgttcccactggcccccctcaagcaaatctaccagtgggggaacagcagccctgggctgtctggtgaag gattactttccagagcccgtgaccgtcagttggaactcaggggctctgactagcggagtgcacaccttccccgc agtcctgcagtcctctgggctgtactccctgagttcagtggtcactgtgcccagctcctctctgggaacacaga cttatatctgcaacgtgaatcacaagccttccaataccaaagtcgacaagaaagtcgagcctaagtcatgtgat aaaacccatacatgcccaagctgtcctgcaccagaatttctgggaggaccaagcgtgttcctgtttccacctaa -continued gcctaaagacaccctgatgattagtcgcactccagaggtgacctgtgtggtcgtggacgtcagccaggaggatc ccgaagtgcagtttaactggtacgtcgatggcgtggaagtccacaatgctaagacaaaaccaagagaggaacag ttcaacagcaagtacagggtcgtgtccgtgctgactgtcctgcatcaggactggctgaacggaaaagagtataa gtgcaaagtgagcaataagggcctgcccagttcaatcgagaaaacaatttccaaggcaaaaggccagcctcggg aaccacaggtgtataccctgccacccagcagagaggaaatgacaaagaaccaggtgtcactgagctgtgccgtc aaaggcttttaccctagcgatatcgctgtggagtgggaatccaatgggcagccagaaaacaattataagaccac acctccagtgctggacagcgatggatccttctttctggtgtccaagctgaccgtggacaaatctcggtggcagc agggcaacgtgttctcctgctctgtcatgcatgaggccctgcacaatcattacacccagaaaagtctgtcactg agcaagtcctgtgataaaacaggaggcgggggatctggcgggggaggcagtgggggaggcgggtccggaggagg aggaagcggaggaggaggatccggaggaggcgggtctggaggcgggggaagtggaggaggaggatcttgcccaa gttgtccagcacctgagttcctgggaggaccatccgtgttcctgtttccccctaagcccaaagacaccctgatg atcagccggacacctgaagtgacttgcgtcgtggtggacgtgtcccaggaggatccagaggtccagtttaactg gtatgtcgatggcgtggaggtccacaatgctaagaccaaacctcgcgaggaacagttcaactctgactaccgag tggtcagtgtgctgacagtcctgcatcaggattggctgaacgggaaggaatacaaatgtaaagtgagcaataag ggactgccaagctccatcgagaagaccatcagcaaagccaaaggccagcccagggaacctcaggtgtacactct gccaccctcccgcgaggaaatgaccaagaaccaggtgtctctgtggtgtctggtcaaaggattttatccctctg acatcgccgtggagtgggaaagtaatggccagcctgaaaacaattacaagactacccctccagtgctggactca gatgggagcttctttctgtatagtaagctgaccgtggataaatcacggtggcagcagggaaatgtgttctcttg cagtgtcatgcacgaggccctgcataaccattacacacagaagtcattaagcttatcgggggaatgtggaggcg gagggagcggcggaggcggcagcgatatcgtgatgacacagtcacccctgtcgctccctgtgactcccggagag cctgcgtccatctcgtgccggtcaacaaagtccctgctgcacagcaatggaattacgtatttgtactggtattt gcaaaaacccggacagagcccgcaattgttgatctaccagatgtcaaaccttgcgagcggggtcccggatcgct ttagctcgtcggggtcaggaactgacttcacactcaaaatctcaagggtcgaggccgaggatgaaggtgtctat tactgcgctcagaatctcgaaatcccgcggacctttggtggaggtacgaagctggagatcaagcgaacgggagg cggtgggtccggtggcggtggttccggcggaggtggttcgggaggaggaggtagccaggtgcagcttgtccagt cgggagcagaggtaaagaagccaggagagtcggtgaaaatctcgtgtaaagcctcggggtacacattcacgaac tacggcatgaattgggtgagacaagctcccgggcagggcttgaaatggatgggatggattaacacctacacagg ggaatccacatatgcggacgacttcaaggggaggttcgcgttttcacttgatacttcagcgagcacggcgtatc tccaactctcgtcgcttcgctccgaagataccgcagtatacttttgcgccagattcgcgattaaaggggactat tggggacaggggacccttgtcacggtgtcatcatgataa >Ab#6-HC-aa (SEQ ID NO: 409)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGS

-continued

DIVMTQSPLSLPVTPGEPASISCRSTKSLLHSDGITYLYWYLQKPGQSPQLLIYQLSNLASGVPDRFSSSGSGT

DFTLKISRVEAEDEGVYYCAQNLEIPRTFGGGTKLEIKRTGGGGSGGGGSGGGGSGGGGSQVQLVQSGAEVKKP

GESVKISCKASGYTFTNYGMNWVRQAPGQGLKWMGWINTYTGESTYADDFKGRFAFSLDTSASTAYLQLSSLRS

EDTAVYFCARFAIKGDYWGQGTLVTVSS**

>Ab#7-HC-aa (SEQ ID NO: 410)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSDIVMTQSPLSLPVTPGE

PASISCRSTKSLLHSDGITYLYWYLQKPGQSPQLLIYQLSN

LASGVPDRFSSSGSGTDFTLKISRVEAEDEGVYYCAQNLEIPRTFGCGTKLEIKRTGGGGSGGGGSGGGGS

GGGGSQVQLVQSGAEVKKPGESVKISCKASGYTFTNYGMNWVRQAPGQCLKWMGWINTYTGESTYADDFKG

RFAFSLDTSASTAYLQLSSLRSEDTAVYFCARFAIKGDYWGQGTLVTVSS**

>Ab#7-HC-nt (SEQ ID NO: 411)

cagctgcagctgcaggagagcggacccggactggtcaagccctccgagacactgtctctgacctgcacagtgtc aggcgggagcatcagctcctctgtctactattggtcttggattcggcagccccctggaaagggcctggaatgga tcggcgtgatctacccaagtgggaacacttactattctcccagtctgaaatccagagtgaccatcagtgtcgac acatcaaagaatcagttcagcctgaaactgagttcagtgacagccgctgatactgcagtctactattgtgccag gaccatctatgacctgtttgatatttgggggcagggaactatggtgaccgtcagctccgctagcactaagggac cttccgtgttcccactggcccccctcaagcaaatctaccagtgggggaacagcagccctgggctgtctggtgaag gattactttccagagcccgtgaccgtcagttggaactcaggggctctgactagcggagtgcacaccttccccgc agtcctgcagtcctctgggctgtactccctgagttcagtggtcactgtgcccagctcctctctgggaacacaga cttatatctgcaacgtgaatcacaagccttccaataccaaagtcgacaagaaagtcgagcctaagtcatgtgat aaaacccatacatgcccaagctgtcctgcaccagaatttctgggaggaccaagcgtgttcctgtttccacctaa gcctaaagacaccctgatgattagtcgcactccagaggtgacctgtgtggtcgtggacgtcagccaggaggatc ccgaagtgcagtttaactggtacgtcgatggcgtggaagtccacaatgctaagacaaaaccaagagaggaacag ttcaacagcaagtacagggtcgtgtccgtgctgactgtcctgcatcaggactggctgaacggaaaagagtataa gtgcaaagtgagcaataagggcctgcccagttcaatcgagaaaacaatttccaaggcaaaaggccagcctcggg aaccacaggtgtataccctgccacccagcagagaggaaatgacaaagaaccaggtgtcactgagctgtgccgtc aaaggcttttaccctagcgatatcgctgtggagtgggaatccaatgggcagccagaaaacaattataagaccac acctccagtgctggacagcgatggatccttctttctggtgtccaagctgaccgtggacaaatctcggtggcagc agggcaacgtgttctcctgctctgtcatgcatgaggccctgcacaatcattacacccagaaaagtctgtcactg agcaagtcctgtgataaaacaggaggcgggggatctggcgggggaggcagtgggggaggcgggtccggaggagg aggaagcggaggaggaggatccggaggaggcgggtctggaggcgggggaagtggaggaggaggatcttgcccaa gttgtccagcacctgagttcctgggaggaccatccgtgttcctgtttccccctaagcccaaagacaccctgatg -continued atcagccggacacctgaagtgacttgcgtcgtggtggacgtgtcccaggaggatccagaggtccagtttaactg gtatgtcgatggcgtggaggtccacaatgctaagaccaaacctcgcgaggaacagttcaactctgactaccgag tggtcagtgtgctgacagtcctgcatcaggattggctgaacgggaaggaatacaaatgtaaagtgagcaataag ggactgccaagctccatcgagaagaccatcagcaaagccaaaggccagcccagggaacctcaggtgtacactct gccaccctcccgcgaggaaatgaccaagaaccaggtgtctctgtggtgtctggtcaaaggattttatccctctg acatcgccgtggagtgggaaagtaatggccagcctgaaaacaattacaagactacccctccagtgctggactca gatgggagcttctttctgtatagtaagctgaccgtggataaatcacggtggcagcagggaaatgtgttctcttg cagtgtcatgcacgaggccctgcataaccattacacacagaagtcattaagcttatcgggggaatgtggaggcg gagggagcggcggaggcggcagcgatatcgtgatgacacagtcacccctgtcgctccctgtgactcccggagag cctgcgtccatctcgtgccggtcaacaaagtccctgctgcacagcgacggaattacgtatttgtactggtattt gcaaaaacccggacagagcccgcaattgttgatctaccagctctcaaaccttgcgagcggggtcccggatcgct ttagctcgtcggggtcaggaactgacttcacactcaaaatctcaagggtcgaggccgaggatgaaggtgtctat tactgcgctcagaatctcgaaatcccgcggacctttggttgcggtacgaagctggagatcaagcgaacgggagg cggtgggtccggtggcggtggttccggcggaggtggttcgggaggaggaggtagccaggtgcagcttgtccagt cgggagcagaggtaaagaagccaggagagtcggtgaaaatctcgtgtaaagcctcggggtacacattcacgaac tacggcatgaattgggtgagacaagctcccgggcagtgtttgaaatggatgggatggattaacacctacacagg ggaatccacatatgcggacgacttcaaggggaggttcgcgttttcacttgatacttcagcgagcacggcgtatc tccaactgtcgtcgcttcgctccgaagataccgcagtatacttttgcgccagattcgcgattaaaggggactat tggggacaggggacccttgtcacggtgtcatcatgataa >Ab#8-HC-aa (SEQ ID NO: 412)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSQVQLVQSGAEVKKPGES

VKISCKASGYTFTNYGMNWVRQAPGQGLKWMGWINTYTGESTYADDFKGRFAFSLDTSASTAYLQLSSLRSEDT

AVYFCARFAIKGDYWGQGTLVTVSSASTGGGGSGGGGSGGGGSGGGGSDIVMTQSPLSLPVTPGEPASISCRST

KSLLHSDGITYLYWYLQKPGQSPQLLIYQMSNLASGVPDRFSSSGSGTDFTLKISRVEAEDEGVYYCAQNLEIP

RTFGGGTKLEIKRT**

>Ab#9-HC-aa (SEQ ID NO: 413)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

-continued

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSQVQLQQSGGGLVKPGES

VKISCAASGYTFTNYGMNWVKQAPGKGLKWMGWINTYTGESTYADDFKGRFTFSLETSASAAYLQINSLRPEDT

AVYFCARFAIKGDYWGQGTTVTVSSASTGGGGSGGGGSGGGGSGGGGSGDIVMTQSPSSLSASVGDKATITCRS

TKSLLHSNGITYLYWYLQKPGKAPKLLIYQMSNLA

SGVPDRFSSSGSGTEFTLTISSVQPEDEGTYYCAQNLEIPRTFGQGTKLEIK**

>Ab#10-HC-aa (SEQ ID NO: 414)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSQVQLQQSGGGLVKPGES

VKISCAASGYTFTNYGMNWVKQAPGKGLKWMGWINTYTGESTYADDFKGRFTFSLETSASAAYLQINSLRPEDT

AVYFCARFAIKGDYWGQGTTVTVSSASTGGGGSGGGGSGGGGSGGGGSGDIVMTQSPSSLSASVGDKATITCRS

TKSLLHSDGITYLYWYLQKPGKAPKLLIYQLSNLASGVPDRFSSSGSGTEFTLTISSVQPEDEGTYYCAQNLEI

PRTFGQGTKLEIK**

>Ab#11-HC-aa (SEQ ID NO: 415)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSDIVMTQSPSSLSASVGD

KATITCRSTKSLLHSNGITYLYWYLQKPGKAPKLLIYQMSNLASGVPDRFSSSGSGTEFTLTISSVQPEDEGTY

YCAQNLEIPRTFGQGTKLEIKRTGGGGSGGGGSGGGGSGGGGSGQVQLQQSGGGLVKPGESVKISCAASGYTFT

NYGMNWVKQAPGKGLKWMGWINTYTGESTYADDFKGRFTFSLETSASAAYLQINSLRPEDTAVYFCARFAIKGD

YWGQGTTVTVSS**

>Ab#12-HC-aa (SEQ ID NO: 416)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

-continued

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSDIVMTQSPSSLSASVGD

KATITCRSTKSLLHSDGITYLYWYLQKPGKAPKLLIYQLSNLASGVPDRFSSSGSGTEFTLTISSVQPEDEGTY

YCAQNLEIPRTFGQGTKLEIKRTGGGGSGGGGSGGGGSGGGGSGQVQLQQSGGGLVKPGESVKISCAASGYTFT

NYGMNWVKQAPGKGLKWMGWINTYTGESTYADDFKGRFTFSLETSASAAYLQINSLRPEDTAVYFCARFAIKGD

YWGQGTTVTVSS**

> Ab#13-HC-aa (SEQ ID NO: 417)

QLQLQESGPGLVKPSETLSLTCTVSGGSISSSVYYWSWIRQPPGKGLEWIGVIYPSGNTYYSPSLKSRVTISVD

TSKNQFSLKLSSVTAADTAVYYCARTIYDLFDIWGQGTMVTVSSASTKGPSVFPLAPSSKSTSGGTAALGCLVK

DYFPEPVTVSWNSGALTSGVHTFPAVLQSSGLYSLSSVVTVPSSSLGTQTYICNVNHKPSNTKVDKKVEPKSCD

KTHTCPSCPAPEFLGGPSVFLFPPKPKDTLMISRTPEVTCVVVDVSQEDPEVQFNWYVDGVEVHNAKTKPREEQ

FNSKYRVVSVLTVLHQDWLNGKEYKCKVSNKGLPSSIEKTISKAKGQPREPQVYTLPPSREEMTKNQVSLSCAV

KGFYPSDIAVEWESNGQPENNYKTTPPVLDSDGSFFLVSKLTVDKSRWQQGNVFSCSVMHEALHNHYTQKSLSL

SKSCDKTGGGGSGGGGSGGGGSGGGGSGGGGSGGGGSGGGGSGGGGSCPSCPAPEFLGGPSVFLFPPKPKDTLM

ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSDIVMTQSPSSLSASVGD

KATITCRSTKSLLHSNGITYLYWYLQKPGKAPKLLIYQMSNLASGVPDRFSSSGSGTEFTLTISSVQPEDEGTY

YCAQNLEIPRTFGQGTKLEIKRTPSHNSHQVPSAGGPTANSGTSGSQVQLQQSGGGLVKPGESVKISCAASGYT

FTNYGMNWVKQAPGKGLKWMGWINTYTGESTYADDFKGRFTFSLETSASAAYLQINSLRPEDTAVYFCARFAIK

GDYWGQGTTVTVSS**

> Ab #13-HC-nt (SEQ ID NO: 418)

cagctgcagctgcaggagagcggacccggactggtcaagccctccgagacactgtctctgacctgcacagtgtc aggcgggagcatcagctcctctgtctactattggtcttggattcggcagcccccctggaaagggcctggaatgga tcggcgtgatctacccaagtgggaacacttactattctcccagtctgaaatccagagtgaccatcagtgtcgac acatcaaagaatcagttcagcctgaaactgagttcagtgacagccgctgatactgcagtctactattgtgccag gaccatctatgacctgtttgatatttgggggcagggaactatggtgaccgtcagctccgctagcactaagggac cttccgtgttcccactggcccccctcaagcaaatctaccagtgggggaacagcagccctgggctgtctggtgaag gattactttccagagcccgtgaccgtcagttggaactcaggggctctgactagcggagtgcacaccttccccgc agtcctgcagtcctctgggctgtactccctgagttcagtggtcactgtgcccagctcctctctgggaacacaga cttatatctgcaacgtgaatcacaagccttccaataccaaagtcgacaagaaagtcgagcctaagtcatgtgat aaaacccatacatgcccaagctgtcctgcaccagaatttctgggaggaccaagcgtgttcctgtttccacctaa gcctaaagacaccctgatgattagtcgcactccagaggtgacctgtgtggtcgtggacgtcagccaggaggatc ccgaagtgcagtttaactggtacgtcgatggcgtggaagtccacaatgctaagacaaaaccaagagaggaacag ttcaacagcaagtacagggtcgtgtccgtgctgactgtcctgcatcaggactggctgaacggaaaagagtataa -continued gtgcaaagtgagcaataagggcctgcccagttcaatcgagaaaacaatttccaaggcaaaaggccagcctcggg aaccacaggtgtataccctgccacccagcagagaggaaatgacaaagaaccaggtgtcactgagctgtgccgtc aaaggcttttaccctagcgatatcgctgtggagtgggaatccaatgggcagccagaaaacaattataagaccac acctccagtgctggacagcgatggatccttctttctggtgtccaagctgaccgtggacaaatctcggtggcagc agggcaacgtgttctcctgctctgtcatgcatgaggccctgcacaatcattacacccagaaaagtctgtcactg agcaagtcctgtgataaaacaggaggcggggggatctggcgggggaggcagtgggggaggcgggtccggaggagg aggaagcggaggaggaggatccggaggaggcgggtctggaggcgggggaagtggaggaggaggatcttgcccaa gttgtccagcacctgagttcctgggaggaccatccgtgttcctgtttccccctaagcccaaagacaccctgatg atcagccggacacctgaagtgacttgcgtcgtggtggacgtgtcccaggaggatccagaggtccagtttaactg gtatgtcgatggcgtggaggtccacaatgctaagaccaaacctcgcgaggaacagttcaactctgactaccgag tggtcagtgtgctgacagtcctgcatcaggattggctgaacgggaaggaatacaaatgtaaagtgagcaataag ggactgccaagctccatcgagaagaccatcagcaaagccaaaggccagcccagggaacctcaggtgtacactct gccaccctcccgcgaggaaatgaccaagaaccaggtgtctctgtggtgtctggtcaaaggattttatccctctg acatcgccgtggagtgggaaagtaatggccagcctgaaaacaattacaagactacccctccagtgctggactca gatgggagcttctttctgtatagtaagctgaccgtggataaatcacggtggcagcagggaaatgtgttctcttg cagtgtcatgcacgaggccctgcataaccattacacacagaagtcattaagcttatcgggagagtgcggtggcg gagggagcggaggaggcgggtcggacatcgtcatgacccagtcaccgtcctcactgtcggcgtcggtgggtgat aaggccacaattacatgccgcagcacgaaatcactgctccactccaatgggattacatatctctattggtatct ccaaaaacccggaaaggcacctaagttgctgatctaccagatgtcgaacttggcatcgggagtacccgataggt tctcgtcgtcgggaagcggcacggagttcacgctcaccatttcctcagtccagccggaggacgaaggaacttac tactgcgctcagaatcttgaaatcccgcgcacatttggacaagggacgaaacttgaaatcaagcgaactccgtc ccacaacagccatcaagtgccctcggcgggagggcccaccgccaattcggggacatcagggagccaggtacagt tgcagcagtcgggaggcgggctggtaaaacctggtgaaagcgtcaagatctcatgtgcagcctcagggtatacg ttcaccaattacgggatgaactgggtgaagcaggcgccagggaaaggtcttaagtggatgggatggatcaacac ttacacgggagagtccacatacgcggatgactttaaggggcggttcacgttttcgttggagacttcagcgtccg ctgcctacctccaaatcaactcccttagacccgaggacacagcggtctatttctgtgcgcggtttgccattaaa ggtgattattggggacagggtacgactgtgaccgtgtccagctgataa cMet-his (bold is signal sequence)

(SEQ ID NO: 419)

MGAPAVLAPGILVLLFTLVQRSNG

ECKEALAKSEMNVNMKYQLPNFTAETPIQNVILHEHHIFLGATNYIYVLNEEDLQKVAEYKTGPVLEHPDCFPC

QDCSSKANLSGGVWKDNINMALVVDTYYDDQLISCGSVNRGTCQRHVFPHNHTADIQSEVHCIFSPQIEEPSQC

PDCVVSALGAKVLSSVKDRFINFFVGNTINSSYFPDHPLHSISVRRLKETKDGFMFLTDQSYIDVLPEFRDSYP

IKYVHAFESNNFIYFLTVQRETLDAQTFHTRIIRFCSINSGLHSYMEMPLECILTEKRKKRSTKKEVFNILQAA

YVSKPGAQLARQIGASLNDDILFGVFAQSKPDSAEPMDRSAMCAFPIKYVNDFFNKIVNKNNVRCLQHFYGPNH

EHCFNRTLLRNSSGCEARRDEYRTEFTTALQRVDLFMGQFSEVLLTSISTFIKGDLTIANLGTSEGRFMQVVVS

RSGPSTPHVNFLLDSHPVSPEVIVEHTLNQNGYTLVITGKKITKIPLNGLGCRHFQSCSQCLSAPPFVQCGWCH

DKCVRSEECLSGTWTQQICLPAIYKVFPNSAPLEGGTRLTICGWDFGFRRNNKFDLKKTRVLLGNESCTLTLSE

STMNTLKCTVGPAMNKHFNMSIIISNGHGTTQYSTFSYVDPVITSISPKYGPMAGGTLLTLTGNYLNSGNSRHI

SIGGKTCTLKSVSNSILECYTPAQTISTEFAVKLKIDLANRETSIFSYREDPIVYEIHPTKSFISGGSTITGVG

KNLNSVSVPRMVINVHEAGRNFTVACQHRSNSEIICCTTPSLQQLNLQLPLKTKAFFMLDGILSKYFDLIYVHN

-continued

PVFKPFEKPVMISMGNENVLEIKGNDIDPEAVKGEVLKVGNKSCENIHLHSEAVLCTVPNDLLKLNSELNIEWK

QAISSTVLGKVIVQPDQNFTGGGGSHHHHHH**

Human EpCAM-Fc-his tagged (bold is signal sequence)

(SEQ ID NO: 420)

MGWSLILLFLVAVATRVLS

QEECVCENYKLAVNCFVNNNRQCQCTSVGAQNTVICSKLAAKCLVMKAEMNGSKLGRRAKPEGALQNNDGLYDP

DCDESGLFKAKQCNGTSMCWCVNTAGVRRTDKDTEITCSERVRTYWIIIELKHKAREKPYDSKSLRTALQKEIT

TRYQLDPKFITSILYENNVITIDLVQNSSQKTQNDVDIADVAYYFEKDVKGESLFHSKKMDLTVNGEQLDLDPG

QTLIYYVDEKAPEFSMQGLKIEGRMDPKSSDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDWLNGKEYKCKVSNKALPAPIEKTISK

AKGQPREPQVYTLPPSRDELTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSHHHHHH**

Anti-c-Met-OA-5D5-HC-aa (SEQ ID NO: 421)

EVQLVESGGGLVQPGGSLRLSCAASGYTFTSYWLHWVRQAPGKGLEWVGMIDPSNSDTRF

NPNFKDRFTISADTSKNTAYLQMNSLRAEDTAVYYCATYRSYVTPLDYWGQGTLVTVSS

Anti-c-Met-OA-5D5-LC-aa (SEQ ID NO: 422)

DIQMTQSPSSLSASVGDRVTITCKSSQSLLYTSSQKNYLAWYQQKPGKAPKLLIYWASTR

ESGVPSRFSGSGSGTDFTLTISSLQPEDFATYYCQQYYAYPWTFGQGTKVEIKR

Anti-c-Met-Fab-HC:

SEQ ID NO: 423

QLQLQESGPGLVKPSETLSLTCTVSGGSISSSVYYWSWIRQPPGKGLEWIGVIYPSGNT

YYSPSLKSRVTISVDTSKNQFSLKLSSVTAADTAVYYCARTIYDLFDIWGQGTMVTVSS

ASTKGPSVFPLAPSSKSTSGGTAALGCLVKDYFPEPVTVSWNSGALTSGVHTFPAVLQS

SGLYSLSSVVTVPSSSLGTQTYICNVNHKPSNTKVDKKV

SEQ ID NO: 424

EPKSC

>Ab#X1-OA-5D5

(SEQ ID NO: 425)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

LSLPVTPGEPASISCRSTKSLLHSNGITYLYWYLQKPGQSPQLLIYQMSNLASGVPDRFSSSGSGTDFTLKISR

VEAEDEGVYYCAQNLEIPRTFGGGTKLEIKRTGGGGSGGGGSGGGGSGGGGSQVQLVQSGAEVKKPGESVKISC

KASGYTFTNYGMNWVRQAPGQGLKWMGWINTYTGESTYADDFKGRFAFSLDTSASTAYLQLSSLRSEDTAVYFC

ARFAIKGDYWGQGTLVTVSS**

-continued

>Ab#X2-OA-5D5

(SEQ ID NO: 426)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSS

ASTKGPSVFPLAPSSKSTSGGTAALGCLVKDYFPEPVTVSWNSGALTSGVHTFPAVLQSSGLYSLSSVVTVPSS

SLGTQTYICNVNHKPSNTKVDKKVEPKSCDKTHTCPSCPAPEFLGGPSVFLFPPKPKDTLMISRTPEVTCVVVD

VSQEDPEVQFNWYVDGVEVHNAKTKPREEQFNSKYRVVSVLTVLHQDWLNGKEYKCKVSNKGLPSSIEKTISKA

KGQPREPQVYTLPPSREEMTKNQVSLSCAVKGFYPSDIAVEWESNGQPENNYKTTPPVLDSDGSFFLVSKLTVD

KSRWQQGNVFSCSVMHEALHNHYTQKSLSLSKSCDKTGGGGSGGGGSGGGGSGGGGSGGGGSGGGGSGGGGSGG

GGSCPSCPAPEFLGGPSVFLFPPKPKDTLMISRTPEVTCVVVDVSQEDPEVQFNWYVDGVEVHNAKTKPREEQF

NSDYRVVSVLTVLHQDWLNGKEYKCKVSNKGLPSSIEKTISKAKGQPREPQVYTLPPSREEMTKNQVSLWCLVK

GFYPSDIAVEWESNGQPENNYKTTPPVLDSDGSFFLYSKLTVDKSRWQQGNVFSCSVMHEALHNHYTQKSLSLS

GECGGGGSGGGGSQVQLVQSGSELKKPGESVKVSCKASGYTFTNYGMHWVRQAPGQGLKWMGWINTYTGESTYA

DDFKGRFAFSLDTSASTAYLQISSLKAEDTAVYFCARFAIKGDYWGQGTLVTVSSASTGGGGSGGGGSGGGGSG

GGGSDIVMTQSPLSLPVTPGEPASISCRSTKSLLHSDGITYLYWYLQKPGQSPQLLIYQLSNLASGVPDRFSSS

GSGTDFTLKISRVEAEDEGVYYCAQNLEIPYTFGQGTKVEIK**

>Ab#X3-OA-5D5

(SEQ ID NO: 427)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSQVQLVQSG

SELKKPGESVKVSCKASGYTFTNYGMNWVRQAPGQGLKWMGWINTYTGESTYADDFKGRFAFSLDTSASTAYLQ

ISSLKAEDTAVYFCARFAIKGDYWGQGTLVTVSSASTGGGGSGGGGSGGGGSGGGGSDIVMTQSPLSLPVTPGE

PASISCRSTKSLLHSDGITYLYWYLQKPGQSPQLLIYQLSNLASGVPDRFSSSGSGTDFTLKISRVEAEDEGVY

YCAQNLEIPRTFGQGTKVEIK**

>Ab#X4-OA-5D5

(SEQ ID NO: 428)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

-continued

LSLPVTPGEPASISCRSTKSLLHSDGITYLYWYLQKPGQSPQLLIYQLSNLASGVPDRFSSSGSGTDFTLKISR

VEAEDEGVYYCAQNLEIPRTFGQGTKVEIKRTGGGGSGGGGSGGGGSGGGGSGQVQLVQSGSELKKPGESVKVS

CKASGYTFTNYGMNWVRQAPGQGLKWMGWINTYTGESTYADDFKGRFAFSLDTSASTAYLQISSLKAEDTAVYF

CARFAIKGDYWGQGTLVTVSS**

>Ab#X5-OA-5D5

(SEQ ID NO: 429)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

LSLPVTPGEPASISCRSTKSLLHSNGITYLYWYLQKPGQSPQLLIYQMSNLASGVPDRFSSSGSGTDFTLKISR

VEAEDEGVYYCAQNLEIPRTFGGGTKLEIKRTGGGGSGGGGSGGGGSGGGGSQVQLVQSGAEVKKPGESVKISC

KASGYTFTNYGMNWVRQAPGQGLKWMGWINTYTGESTYADDFKGRFAFSLDTSASTAYLQLSSLRSEDTAVYFC

ARFAIKGDYWGQGTLVTVSS**

>Ab#X6-OA-5D5

(SEQ ID NO: 430)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSS

ASTKGPSVFPLAPSSKSTSGGTAALGCLVKDYFPEPVTVSWNSGALTSGVHTFPAVLQSSGLYSLSSVVTVPSS

SLGTQTYICNVNHKPSNTKVDKKVEPKSCDKTHTCPSCPAPEFLGGPSVFLFPPKPKDTLMISRTPEVTCVVVD

VSQEDPEVQFNWYVDGVEVHNAKTKPREEQFNSKYRVVSVLTVLHQDWLNGKEYKCKVSNKGLPSSIEKTISKA

KGQPREPQVYTLPPSREEMTKNQVSLSCAVKGFYPSDIAVEWESNGQPENNYKTTPPVLDSDGSFFLVSKLTVD

KSRWQQGNVFSCSVMHEALHNHYTQKSLSLSKSCDKTGGGGSGGGGSGGGGSGGGGSGGGGSGGGGSGGGGSGG

GGSCPSCPAPEFLGGPSVFLFPPKPKDTLMISRTPEVTCVVVDVSQEDPEVQFNWYVDGVEVHNAKTKPREEQF

NSDYRVVSVLTVLHQDWLNGKEYKCKVSNKGLPSSIEKTISKAKGQPREPQVYTLPPSREEMTKNQVSLWCLVK

GFYPSDIAVEWESNGQPENNYKTTPPVLDSDGSFFLYSKLTVDKSRWQQGNVFSCSVMHEALHNHYTQKSLSLS

GECGGGGSGGGGSDIVMTQSPLSLPVTPGEPASISCRSTKSLLHSDGITYLYWYLQKPGQSPQLLIYQLSNLAS

GVPDRFSSSGSGTDFTLKISRVEAEDEGVYYCAQNLEIPRTFGGGTKLEIKRTGGGGSGGGGSGGGGSGGGGSQ

VQLVQSGAEVKKPGESVKISCKASGYTFTNYGMNWVRQAPGQGLKWMGWINTYTGESTYADDFKGRFAFSLDTS

ASTAYLQLSSLRSEDTAVYFCARFAIKGDYWGQGTLVTVSS**

>Ab#X7-OA-5D5

(SEQ ID NO: 431)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

-continued

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

LSLPVTPGEPASISCRSTKSLLHSDGITYLYWYLQKPGQSPQLLIYQLSNLASGVPDRFSSSGSGTDFTLKISR

VEAEDEGVYYCAQNLEIPRTFGCGTKLEIKRTGGGGSGGGGSGGGGSGGGGSQVQLVQSGAEVKKPGESVKISC

KASGYTFTNYGMNWVRQAPGQCLKWMGWINTYTGESTYADDFKGRFAFSLDTSASTAYLQLSSLRSEDTAVYFC

ARFAIKGDYWGQGTLVTVSS**

>Ab#X8-OA-5D5

(SEQ ID NO: 432)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSQVQLVQSG

AEVKKPGESVKISCKASGYTFTNYGMNWVRQAPGQGLKWMGWINTYTGESTYADDFKGRFAFSLDTSASTAYLQ

LSSLRSEDTAVYFCARFAIKGDYWGQGTLVTVSSASTGGGGSGGGGSGGGGSGGGGSDIVMTQSPLSLPVTPGE

PASISCRSTKSLLHSDGITYLYWYLQKPGQSPQLLIYQMSNLASGVPDRFSSSGSGTDFTLKISRVEAEDEGVY

YCAQNLEIPRTFGGGTKLEIKRT**

>Ab#X9-OA-5D5

(SEQ ID NO: 433)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSS

ASTKGPSVFPLAPSSKSTSGGTAALGCLVKDYFPEPVTVSWNSGALTSGVHTFPAVLQSSGLYSLSSVVTVPSS

SLGTQTYICNVNHKPSNTKVDKKVEPKSCDKTHTCPSCPAPEFLGGPSVFLFPPKPKDTLMISRTPEVTCVVVD

VSQEDPEVQFNWYVDGVEVHNAKTKPREEQFNSKYRVVSVLTVLHQDWLNGKEYKCKVSNKGLPSSIEKTISKA

KGQPREPQVYTLPPSREEMTKNQVSLSCAVKGFYPSDIAVEWESNGQPENNYKTTPPVLDSDGSFFLVSKLTVD

KSRWQQGNVFSCSVMHEALHNHYTQKSLSLSKSCDKTGGGGSGGGGSGGGGSGGGGSGGGGSGGGGSGGGGSGG

GGSCPSCPAPEFLGGPSVFLFPPKPKDTLMISRTPEVTCVVVDVSQEDPEVQFNWYVDGVEVHNAKTKPREEQF

NSDYRVVSVLTVLHQDWLNGKEYKCKVSNKGLPSSIEKTISKAKGQPREPQVYTLPPSREEMTKNQVSLWCLVK

GFYPSDIAVEWESNGQPENNYKTTPPVLDSDGSFFLYSKLTVDKSRWQQGNVFSCSVMHEALHNHYTQKSLSLS

GECGGGGSGGGGSQVQLQQSGGGLVKPGESVKISCAASGYTFTNYGMNWVKQAPGKGLKWMGWINTYTGESTYA

DDFKGRFTFSLETSASAAYLQINSLRPEDTAVYFCARFAIKGDYWGQGTTVTVSSASTGGGGSGGGGSGGGGSG

GGGSGDIVMTQSPSSLSASVGDKATITCRSTKSLLHSNGITYLYWYLQKPGKAPKLLIYQMSNLASGVPDRFSS

SGSGTEFTLTISSVQPEDEGTYYCAQNLEIPRTFGQGTKLEIK**

>Ab#X10-OA-5D5

(SEQ ID NO: 434)

EVQLVESGGGLVQPGGSLRLSCAASGYTFTSYWLHWVRQAPGKGLEWVGMIDPSNSDTRFNPNFKDRFTISADT

SKNTAYLQMNSLRAEDTAVYYCATYRSYVTPLDYWGQGTLVTVSSASTKGPSVFPLAPSSKSTSGGTAALGCLV

-continued

KDYFPEPVTVSWNSGALTSGVHTFPAVLQSSGLYSLSSVVTVPSSSLGTQTYICNVNHKPSNTKVDKKVEPKSC

DKTHTCPSCPAPEFLGGPSVFLFPPKPKDTLMISRTPEVTCVVVDVSQEDPEVQFNWYVDGVEVHNAKTKPREE

QFNSKYRVVSVLTVLHQDWLNGKEYKCKVSNKGLPSSIEKTISKAKGQPREPQVYTLPPSREEMTKNQVSLSCA

VKGFYPSDIAVEWESNGQPENNYKTTPPVLDSDGSFFLVSKLTVDKSRWQQGNVFSCSVMHEALHNHYTQKSLS

LSKSCDKTGGGGSGGGGSGGGGSGGGGSGGGGSGGGGSGGGGSGGGGSCPSCPAPEFLGGPSVFLFPPKPKDTL

MISRTPEVTCVVVDVSQEDPEVQFNWYVDGVEVHNAKTKPREEQFNSDYRVVSVLTVLHQDWLNGKEYKCKVSN

KGLPSSIEKTISKAKGQPREPQVYTLPPSREEMTKNQVSLWCLVKGFYPSDIAVEWESNGQPENNYKTTPPVLD

SDGSFFLYSKLTVDKSRWQQGNVFSCSVMHEALHNHYTQKSLSLSGECGGGGSGGGGSQVQLQQSGGGLVKPGE

SVKISCAASGYTFTNYGMNWVKQAPGKGLKWMGWINTYTGESTYADDFKGRFTFSLETSASAAYLQINSLRPED

TAVYFCARFAIKGDYWGQGTTVTVSSASTGGGGSGGGGSGGGGSGGGGSGDIVMTQSPSSLSASVGDKATITCR

STKSLLHSDGITYLYWYLQKPGKAPKLLIYQLSNLASGVPDRFSSSGSGTEFTLTISSVQPEDEGTYYCAQNLE

IPRTFGQGTKLEIK**

>Ab#X11-OA-5D5

(SEQ ID NO: 435)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

SSLSASVGDKATITCRSTKSLLHSNGITYLYWYLQKPGKAPKLLIYQMSNLASGVPDRFSSSGSGTEFTLTISS

VQPEDEGTYYCAQNLEIPRTFGQGTKLEIKRTGGGGSGGGGSGGGGSGGGGSGQVQLQQSGGGLVKPGESVKIS

CAASGYTFTNYGMNWVKQAPGKGLKWMGWINTYTGESTYADDFKGRFTFSLETSASAAYLQINSLRPEDTAVYF

CARFAIKGDYWGQGTTVTVSS**

>Ab#X12-OA-5D5

(SEQ ID NO: 436)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

SSLSASVGDKATITCRSTKSLLHSDGITYLYWYLQKPGKAPKLLIYQLSNLASGVPDRFSSSGSGTEFTLTISS

VQPEDEGTYYCAQNLEIPRTFGQGTKLEIKRTGGGGSGGGGSGGGGSGGGGSGQVQLQQSGGGLVKPGESVKIS

-continued

CAASGYTFTNYGMNWVKQAPGKGLKWMGWINTYTGESTYADDFKGRFTFSLETSASAAYLQINSLRPEDTAVYF

CARFAIKGDYWGQGTTVTVSS**

>Ab#X13-OA-5D5

(SEQ ID NO: 437)

EVQLVESGGGLVQPGGSLRLSCAASGYTFTSYWLHWVRQAPGKGLEWVGMIDPSNSDTRFNPNFKD

RFTISADTSKNTAYLQMNSLRAEDTAVYYCATYRSYVTPLDYWGQGTLVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPSNTKVD

KKVEPKSCDKTHTCPSCPAPEFLGGPSVFLFPPKPKDTLMISRTPEVTCVVVDVSQEDPEVQFNWYVDGVEVHN

AKTKPREEQFNSKYRVVSVLTVLHQDWLNGKEYKCKVSNKGLPSSIEKTISKAKGQPREPQVYTLPPSREEMTK

NQVSLSCAVKGFYPSDIAVEWESNGQPENNYKTTPPVLDSDGSFFLVSKLTVDKSRWQQGNVFSCSVMHEALHN

HYTQKSLSLSKSCDKTGGGGSGGGGSGGGGSGGGGSGGGGSGGGGSGGGGSGGGGSCPSCPAPEFLGGPSVFLF

PPKPKDTLMISRTPEVTCVVVDVSQEDPEVQFNWYVDGVEVHNAKTKPREEQFNSDYRVVSVLTVLHQDWLNGK

EYKCKVSNKGLPSSIEKTISKAKGQPREPQVYTLPPSREEMTKNQVSLWCLVKGFYPSDIAVEWESNGQPENNY

KTTPPVLDSDGSFFLYSKLTVDKSRWQQGNVFSCSVMHEALHNHYTQKSLSLSGECGGGGSGGGGSDIVMTQSP

SSLSASVGDKATITCRSTKSLLHSNGITYLYWYLQKPGKAPKLLIYQMSNLASGVPDRFSSSGSGTEFTLTISS

VQPEDEGTYYCAQNLEIPRTFGQGTKLEIKRTPSHNSHQVPSAGGPTANSGTSGSQVQLQQSGGGLVKPGESVK

ISCAASGYTFTNYGMNWVKQAPGKGLKWMGWINTYTGESTYADDFKGRFTFSLETSASAAYLQINSLRPEDTAV

YFCARFAIKGDYWGQGTTVTVSS**

>Anti-EpCAM-HC1 aa (SEQ ID NO: 438)

QVQLVQSGAEVKKPGASVKVSCKASGYTFTNYGMNWVRQAPGQGLKWMGWINTYTGESTYADDFKGRVTITADT

SASTAYMELSSLRSEDTAVYYCARFAIKGDYWGQGTLVTVSS

>Anti-EpCAM-HC1 nt (SEQ ID NO: 439)

caagtgcagttggtccagagcggtgcggaggtaaagaaacccggtgcatccgtgaaggtgtcgtgcaaagcctc cgggtatacgttcacgaactatgggatgaactgggtcagacaagcaccgggtcagggactcaaatggatggggt ggatcaatacatacacaggggaatcgacctacgcggatgactttaagggaagggtcaccattacggcggacacc tcggcatcgactgcgtatatggaactctcatcacttcgctcggaggacacagccgtctactattgtgcgcggtt tgcgatcaagggagattactggggacagggaactttggtaacagtatcaagc >Anti-EpCAM-HC2 aa (SEQ ID NO: 440)

QVQLVQSGAEVKKPGASVKVSCKASGYTFTNYGMNWVRQAPGQGLKWMGWINTYTGESTYADDFKGRVTITLDT

SASTAYMELSSLRSEDTAVYFCARFAIKGDYWGQGTLVTVSS

>Anti-EpCAM-HC2 nt (SEQ ID NO: 441)

caagtgcagttggtccagagcggtgcggaggtaaagaaacccggtgcatccgtgaaggtgtcgtgcaaagcctc cgggtatacgttcacgaactatgggatgaactgggtcagacaagcaccgggtcagggactcaaatggatggggt ggatcaatacatacacaggggaatcgacctacgcggatgactttaagggaagggtcaccattacgttggacacc tcggcatcgactgcgtatatggaactctcatcacttcgctcggaggacacagccgtctacttctgtgcgcggtt tgcgatcaagggagattactggggacagggaactttggtaacagtatcaagc >anti-EpCAM-HC3 aa (SEQ ID NO: 442)

QVQLQQSGGGLVKPGGSVKISCKASGYTFTNYGMNWVKQAPGKGLKWMGWINTYTGESTYADDFKGRFAFSLET

SASAAYLQINSLRPEDTAVYFCARFAIKGDYWGQGTLVTVSS

>Anti-EpCAM-HC3 nt (SEQ ID NO: 443)

caggtacagctgcagcaaagcgggggaggactcgtgaagcctggtggttcggtcaaaatctcgtgtaaagcgtc agggtacaccttcacaaactatggtatgaactgggtgaaacaggcacccggaaagggtcttaagtggatgggct -continued ggatcaatacctacacgggggagtcgacatatgcggacgactttaaaggacggttcgcgttttcgttggagact agcgcctccgctgcctacctccaaatcaatagccttaggccggaagatacggcggtctacttttgcgcaagatt tgccattaagggggattattggggccaggggacgctggtgacagtcagctccgctagc >anti-EpCAM-HC4 aa (SEQ ID NO: 444)

QVQLVQSGAEVKKPGASVKVSCKASGYTFTNYGMNWVRQAPGQGLKWMGWINTYTGESTYADDFKGRFAFSLDT

SASTAYMELSSLRSEDTAVYFCARFAIKGDYWGQGTLVTVSS

>anti-EpCAM-HC4 nt (SEQ ID NO: 445)

caggtccagcttgtgcagtccggagccgaagtcaagaagccgggagccagcgtaaaggtgtcatgtaaggcgtc ggggtatacattcacgaactacggtatgaattgggtgcgccaagctcccggacagggtttgaaatggatggggt ggatcaacacgtatacaggggaatcaacttacgccgacgacttcaagggaaggttcgcattttcgttggataca tcggcgtccacggcgtacatggagctgtcaagcctgcggtcggaggacacggcggtatacttctgcgcaagatt tgctatcaaaggtgattattggggggcagggaaccctggtaaccgtgagcagc >anti-EpCAM-HC5 aa (SEQ ID NO: 446)

QVQLVQSGSELKKPGASVKVSCKASGYTFTNYGMNWVRQAPGQGLKWMGWINTYTGESTYADDFKGRFAFSLDT

SASTAYLQISSLKAEDTAVYFCARFAIKGDYWGQGTLVTVSS

>anti-EpCAM-HC5 nt (SEQ ID NO: 447)

caggtccagctggtgcagtcaggttcagagctgaagaagcccggagcgtccgtcaaagtgtcatgcaaggcctc gggttacacgtttacgaactacggtatgaattgggtccgccaggctccgggccagggactgaaatggatgggat ggatcaacacatatactggtgaatccacgtatgcggacgactttaagggggagattcgcgttcagccttgataca tcggcgtcgaccgcgtacctccaaatctcgtccttgaaagcagaggacactgcagtatacttttgtgcccggtt cgctatcaagggagattattggggccaagggaccttggtgacagtgtccagc >anti-EpCAM-HC6 aa (SEQ ID NO: 448)

QVQLVQSGAEVKKPGASVKISCKASGYTFTNYGMNWVRQAPGQGLKWMGWINTYTGESTYADDFKGRFTITLDT

SASTAYMELSSLRSEDTAVYYCARFAIKGDYWGQGTLVTVSS

>anti-EpCAM-HC6 nt (SEQ ID NO: 449)

caagtccagttggtacaatcgggtgccgaggtaaagaaaccgggagcgtcggtcaaaatcagctgcaaggcctc aggctatacctttacaaactacggcatgaattgggtgagacaggcacccgggcagggattgaaatggatgggtt ggatcaacacgtatacaggggagtccacctatgcagatgactttaaggggcgcttcactatcacgctcgacacg tccgcgtcgacggcgtacatggaactgtcatcgcttcggagcgaagatacagccgtgtactattgtgctaggtt tgcgattaagggagactactggggacagggaaccctcgtaactgtgtcatca >anti-EpCAM-HC7 aa (SEQ ID NO: 450)

QVQLVQSGAEVKKPGASVKISCKASGYTFTNYGMNWVRQAPGQGLKWMGWINTYTGESTYADDFKGRFAFSLDT

SASTAYLQLSSLRSEDTAVYFCARFAIKGDYWGQGTLVTVSS

>anti-EpCAM-HC7 nt (SEQ ID NO: 451)

caagtgcagctggtacaatcaggtgcggaggtgaaaaagccgggtgcctccgtcaagatttcatgcaaggcctc gggatacacattcaccaactatgggatgaattgggtgaggcaggctcccggtcaggggttgaaatggatggggt ggattaacacatatacgggagaaagcacgtatgcggacgacttcaaggggcgcttcgcgttttccctggatact tcggcatcgactgcgtacctccagttgtcgtcgcttagatccgaggacacggccgtctacttctgtgcacggtt tgcaatcaagggggattactggggacagggaacgcttgtaaccgtaagctca -continued >Anti-EpCAM-LC1 aa (SEQ ID NO: 452)

DIVMTQSPLSLPVTPGEPASISCRSTKSLLHSNGITYLYWYLQKPGQSPQLLIYQMSNLASGVPDRFSGSGSGT

DFTLKISRVEAEDVGVYYCAQNLEIPRTFGQGTKVEIK

>Anti-EpCAM-LC1 nt (SEQ ID NO: 453)

gacattgtcatgacgcagtcgccgctctcgctcccggtcacaccgggagaacccgcgtccatttcatgcagatc gacaaagtcactcctccattcaaatggaatcacttacttgtactggtatcttcaaaaacccggtcagtcaccac agttgctcatctaccaaatgtccaatttggcttcgggagtgcccgaccgattcagcggttcggggagcggtacg gattttacgttgaagatcagcagggtagaggcggaggacgtgggggtgtactattgtgcacagaaccttgaaat tccacgcacctttggacaaggcaccaaggtcgaaatcaagcgtacggtggcggcaccttcagtgttcatctttc cccttccgatgaacagctcaaaagcgggactgcatccgtagtctgtcttttgaacaacttctatcccagagag gcgaaagtacagtggaaggtggacaacgcccttcaatcaggcaatagccaggagtcggtgacggagcaggattc caaagatagcacatactcgctttcatccactttgacattgtcgaaagcggactacgaaaagcacaaggtctatg cgtgcgaggtgacgcaccagggactttcgtcgccggtaaccaagtcgttcaatcgcggggagtgctgataa >Anti-EpCAM-LC2 aa (SEQ ID NO: 454)

DIVMTQSPSSLSASVGDKATITCRSTKSLLHSNGITYLYWYLQKPGKAPKLLIYQMSNLASGVPDRFSSSGSGT

DFTLRISSVQPEDFATYYCAQNLEIPRTFGGGTKLEIK

>Anti-EpCAM-LC2 nt (SEQ ID NO: 455)

gacattgtcatgacccagtcgccgtcatccctttcagcgagcgtgggggataaggcaacgatcacgtgtcgaag caccaaatccttgctgcacagcaacgggattacgtatttgtactggtatttgcaaaaacccgggaaagccccga agctcctcatctaccagatgtcgaatctggcgtcgggggtgccagatcggttctccagcagcgggtcgggtaca gacttcacactccggatctcatcagtgcagcccgaggactttgcgacctactattgtgcccaaaatcttgaaat cccgagaacgttcggaggtggcacgaaattggagattaaa >anti-EpCAM-LC3 aa (SEQ ID NO: 456)

DIVMTQSPLSLPVTPGEPASISCRSTKSLLHSNGITYLYWYLQKPGQSPQLLIYQMSNLASGVPDRFSSSGSGT

DFTLKISRVEAEDVGVYYCAQNLEIPRTFGQGTKVEIK

>anti-EpCAM-LC3 nt (SEQ ID NO: 457)

gatatcgtaatgacccaatcgccgttgtcgcttccagtcacacccggggagcctgcttcgattagctgcagatc aacgaagtcgctcctccattcaaacgggattacgtatttgtactggtatcttcaaaagccgggtcagagcccgc agctgctgatctaccagatgtccaacttggcctcgggcgtccccgaccggtttagcagcagcgggtcgggaacg gacttcactctcaagatctcaagggtcgaagcggaagatgtgggtgtgtattactgtgcgcagaatcttgagat tccccgaacattcggtcagggaaccaaagtcgagatcaag >anti-EpCAM-LC4 aa (SEQ ID NO: 458)

DIVMTQSPLSLPVTPGEPASISCRSTKSLLHSNGITYLYWYLQKPGQSPQLLIYQMSNLASGVPDRFSSSGSGT

DFTLKISRVEAEDVGVYYCAQNLEIPRTFGGGTKLEIK

>anti-EpCAM-LC4 NT (SEQ ID NO: 459)

Gacatcgtgatgacgcagtccccactgtcgctccctgtaacaccaggggagcccgcttccatttcgtgtaggtc aacgaagtccttgcttcatagcaatgggatcacttacttgtactggtatctccaaaaaccgggtcagtcccctc agttgctgatctaccagatgtcgaaccttgcgagcggtgtcccggatcgattttcatcgtccggatcgggaacc gacttcacactgaagattagccgcgtggaggccgaagatgtcggggtctactactgtgctcaaaaccttgagat tccccggacgtttggaggcggcacgaagctggaaatcaag -continued >Anti-EpCAM scFv-v1 aa (SEQ ID NO: 460)

QVQLVQSGSELKKPGESVKVSCKASGYTFTNYGMNWVRQAPGQCLKWMGWINTYTGESTYADDFKGRFAFSLDT

SASTAYLQISSLKAEDTAVYFCARFAIKGDYWGQGTLVTVSSASTGGGGSGGGGSGGGGSGGGGSDIVMTQSPL

SLPVTPGEPASISCRSTKSLLHSDGITYLYWYLQKPGQSPQLLIYQLSNLASGVPDRFSSSGSGT
                                    *                          *

DFTLKISRVEAEDEGVYYCAQNLEIPRTFGCGTKVEIK**

>Anti-EpCAM scFv-v1 nt (SEQ ID NO: 461)

caggtacaactcgtgcagtcggggtcggagcttaagaagccgggagagtcggtaaaagtgtcgtgtaaagcctc cgggtatacctttacgaattacggcatgaactgggtccggcaggcacccggtcagtgtctcaagtggatgggct ggatcaatacgtacacgggcgaatccacttatgcagatgactttaagggaagattcgcgttctcattggacaca tcagcgtcaacggcgtatcttcaaatttcgtccttgaaagcggaggacacggcggtctatttctgcgcacgatt cgctatcaaaggagattactggggtcaggggacacttgtgacagtgtcgagcgccagcaccggaggtggaggga gcggaggaggaggtagcggtggcggtggctcgggtggaggtggatcggacatcgtcatgactcagagccctctg tcactgcccgtaactcccggggagcccgcctccattagctgtcggtcgacaaagtccttgctccactcagatgg aatcacgtatttgtactggtacttgcaaaagcctggacagtcgccacagctccttatctaccagttgtccaacc tggcgtcgggagtaccggaccgcttttcatcatccgggtcaggcaccgatttcacactgaagattagccgcgtg gaggcggaggacgaaggggtctactactgcgcccagaacctcgaaattccgaggacctttggatgcggtactaa agtggaaatcaagtgataa >Anti-EpCAM scFv-v2 aa (SEQ ID NO: 462)

QVQLVQSGSELKKPGESVKVSCKASGYTFTNYGMHWVRQAPGQGLKWMGWINTYTGESTYADDFKGRFAFSLDT

SASTAYLQISSLKAEDTAVYFCARFAIKGDYWGQGTLVTVSSASTGGGGSGGGGSGGGGSGGGGSDIVMTQSPL

SLPVTPGEPASISCRSTKSLLHSDGITYLYWYLQKPGQSPQLLIYQLSNLASGVPDRFSSSGSGT
                                    *                          *

DFTLKISRVEAEDEGVYYCAQNLEIPYTFGQGTKVEIK**

>Anti-EpCAM scFv-v2 nt (SEQ ID NO: 463)

caggtacaactcgtgcagtcggggtcggagcttaagaagccgggagagtcggtaaaagtgtcgtgtaaagcctc cgggtatacctttacgaattacggcatgcattgggtccggcaggcacccggtcaggggctcaagtggatgggct ggatcaatacgtacacgggcgaatccacttatgcagatgactttaagggaagattcgcgttctcattggacaca tcagcgtcaacggcgtatcttcaaatttcgtccttgaaagcggaggacacggcggtctatttctgcgcacgatt cgctatcaaaggagattactggggtcaggggacacttgtgacagtgtcgagcgccagcaccggaggtggaggga gcggaggaggaggtagcggtggcggtggctcgggtggaggtggatcggacatcgtcatgactcagagccctctg tcactgcccgtaactcccggggagcccgcctccattagctgtcggtcgacaaagtccttgctccactcagatgg aatcacgtatttgtactggtacttgcaaaagcctggacagtcgccacagctccttatctaccagttgtccaacc tggcgtcgggagtaccggaccgcttttcatcatccgggtcaggcaccgatttcacactgaagattagccgcgtg gaggcggaggacgaaggggtctactactgcgcccagaacctcgaaattccgtacacctttggacaaggtactaa agtggaaatcaagtgataa >Anti-EpCAM scFv-v3 aa (SEQ ID NO: 464)

QVQLVQSGSELKKPGESVKVSCKASGYTFTNYGMNWVRQAPGQGLKWMGWINTYTGESTYADDFKGRFAFSLDT

SASTAYLQISSLKAEDTAVYFCARFAIKGDYWGQGTLVTVSSASTGGGGSGGGGSGGGGSGGGGSDIVMTQSPL

SLPVTPGEPASISCRSTKSLLHSDGITYLYWYLQKPGQSPQLLIYQLSNLASGVPDRFSSSGSGT
                                    *                          *

DFTLKISRVEAEDEGVYYCAQNLEIPRTFGQGTKVEIK **

-continued

>Anti-EpCAM scFv-v3 nt (SEQ ID NO: 465)

caggtacaactcgtgcagtcggggtcggagcttaagaagccgggagagtcggtaaaagtgtcgtgtaaagcctc cgggtatacctttacgaattacggcatgaactgggtccggcaggcacccggtcaggggctcaagtggatgggct ggatcaatacgtacacgggcgaatccacttatgcagatgactttaagggaagattcgcgttctcattggacaca tcagcgtcaacggcgtatcttcaaatttcgtccttgaaagcggaggacacggcggtctatttctgcgcacgatt cgctatcaaaggagattactggggtcaggggacacttgtgacagtgtcgagcgccagcaccggaggtggaggga gcggaggaggaggtagcggtggcggtggctcgggtggaggtggatcggacatcgtcatgactcagagccctctg tcactgcccgtaactcccggggagcccgcctccattagctgtcggtcgacaaagtccttgctccactcagatgg aatcacgtatttgtactggtacttgcaaaagcctggacagtcgccacagctccttatctaccagttgtccaacc tggcgtcgggagtaccggaccgcttttcatcatccgggtcaggcaccgatttcacactgaagattagccgcgtg gaggcggaggacgaaggggtctactactgcgcccagaacctcgaaattccgaggacctttggacaaggtactaa agtggaaatcaagtgataa >Anti-EpCAM scFv-v4 aa (SEQ ID NO: 466)

DIVMTQSPLSLPVTPGEPASISCRSTKSLLHSDGITYLYWYLQKPGQSPQLLIYQLSNLASGVPDRFSSSG

* *

SGTDFTLKISRVEAEDEGVYYCAQNLEIPRTFGQGTKVEIKRTGGGGSGGGGSGGGGSGGGGSGQVQLVQSGSE

LKKPGESVKVSCKASGYTFTNYGMNWVRQAPGQGLKWMGWINTYTGESTYADDFKGRFAFSLDTSASTAYLQIS

SLKAEDTAVYFCARFAIKGDYWGQGTLVTVSS**

>Anti-EpCAM scFv-v4 nt (SEQ ID NO: 467)

gatatcgtgatgacacagtcacccctgtcgctccctgtgactcccggagagcctgcgtccatctcgtgccggtc aacaaagtccctgctgcacagcgacggaattacgtatttgtactggtatttgcaaaaacccggacagagcccgc aattgttgatctaccagctctcaaaccttgcgagcggggtcccggatcgctttagctcgtcggggtcaggaact gacttcacactcaaaatctcaagggtcgaggccgaggatgaaggtgtctattactgcgctcagaatctcgaaat cccgcggacctttggtcagggtacgaaggtagagatcaagcgaacgggaggcggtgggtccggtggcggtggtt ccggcggaggtggttcgggaggaggaggtagcggtcaggtgcagcttgtccagtcgggatcggagctcaagaag ccaggagagtcggtgaaagtatcgtgtaaagcctcggggtacacattcacgaactacggcatgaattgggtgag acaagctcccgggcagggcttgaaatggatgggatggattaacacctacacaggggaatccacatatgcggacg acttcaaggggaggttcgcgttttcacttgatacttcagcgagcacggcgtatctccaaatttcgtcgcttaag gcagaagataccgcagtatacttttgcgccagattcgcgattaaaggggactattggggacaggggacccttgt cacggtgtcatcatgataa >Anti-EpCAM scFv-v5 aa (SEQ ID NO: 468)

DIVMTQSPLSLPVTPGEPASISCRSTKSLLHSNGITYLYWYLQKPGQSPQLLIYQMSNLASGVPDRFSSSGSGT

DFTLKISRVEAEDEGVYYCAQNLEIPRTFGGGTKLEIKRTGGGGSGGGGSGGGGSGGGGSQVQLVQSGAEVKKP

GESVKISCKASGYTFTNYGMNWVRQAPGQGLKWMGWINTYTGESTYADDFKGRFAFSLDTSASTAYLQLSSLRS

EDTAVYFCARFAIKGDYWGQGTLVTVSS**

>Anti-EpCAM scFv-v5 nt (SEQ ID NO: 469)

gatatcgtgatgacacagtcacccctgtcgctccctgtgactcccggagagcctgcgtccatctcgtgccggtc aacaaagtccctgctgcacagcaatggaattacgtatttgtactggtatttgcaaaaacccggacagagcccgc aattgttgatctaccagatgtcaaaccttgcgagcggggtcccggatcgctttagctcgtcggggtcaggaact gacttcacactcaaaatctcaagggtcgaggccgaggatgaaggtgtctattactgcgctcagaatctcgaaat cccgcggacctttggtggaggtacgaagctggagatcaagcgaacgggaggcggtgggtccggtggcggtggtt -continued ccggcggaggtggttcgggaggaggaggtagccaggtgcagcttgtccagtcgggagcagaggtaaagaagcca ggagagtcggtgaaaatctcgtgtaaagcctcggggtacacattcacgaactacggcatgaattgggtgagaca agctcccgggcagggcttgaaatggatgggatggattaacacctacacaggggaatccacatatgcggacgact tcaaggggaggttcgcgttttcacttgatacttcagcgagcacggcgtatctccaactctcgtcgcttcgctcc gaagataccgcagtatacttttgcgccagattcgcgattaaaggggactattggggacaggggacccttgtcac ggtgtcatcatgataa >Anti-EpCAM scFv-v6 aa (SEQ ID NO: 470)

DIVMTQSPLSLPVTPGEPASISCRSTKSLLHSDGITYLYWYLQKPGQSPQLLIYQLSNLASGVPDRFSSSG
* *

SGTDFTLKISRVEAEDEGVYYCAQNLEIPRTFGGGTKLEIKRTGGGGSGGGGSGGGGSGGGGSQVQLVQSGAEV

KKPGESVKISCKASGYTFTNYGMNWVRQAPGQGLKWMGWINTYTGESTYADDFKGRFAFSLDTSASTAYLQLSS

LRSEDTAVYFCARFAIKGDYWGQGTLVTVSS**

>Anti-EpCAM scFv-v6 nt (SEQ ID NO: 471)

gatatcgtgatgacacagtcacccctgtcgctccctgtgactcccggagagcctgcgtccatctcgtgccggtc aacaaagtccctgctgcacagcgacggaattacgtatttgtactggtatttgcaaaaacccggacagagcccgc aattgttgatctaccagctctcaaaccttgcgagcggggtcccggatcgctttagctcgtcggggtcaggaact gacttcacactcaaaatctcaagggtcgaggccgaggatgaaggtgtctattactgcgctcagaatctcgaaat cccgcggacctttggtggaggtacgaagctggagatcaagcgaacgggaggcggtgggtccggtggcggtggtt ccggcggaggtggttcgggaggaggaggtagccaggtgcagcttgtccagtcgggagcagaggtaaagaagcca ggagagtcggtgaaaatctcgtgtaaagcctcggggtacacattcacgaactacggcatgaattgggtgagaca agctcccgggcagggcttgaaatggatgggatggattaacacctacacaggggaatccacatatgcggacgact tcaaggggaggttcgcgttttcacttgatacttcagcgagcacggcgtatctccaactgtcgtcgcttcgctcc gaagataccgcagtatacttttgcgccagattcgcgattaaaggggactattggggacaggggacccttgtcac ggtgtcatcatgataa >Anti-EpCAM scFv-v7 aa (SEQ ID NO: 472)

DIVMTQSPLSLPVTPGEPASISCRSTKSLLHSDGITYLYWYLQKPGQSPQLLIYQLSNLASGVPDRFSSSG

SGTDFTLKISRVEAEDEGVYYCAQNLEIPRTFGCGTKLEIKRTGGGGSGGGGSGGGGSGGGGSQVQLVQSGAEV

KKPGESVKISCKASGYTFTNYGMNWVRQAPGQCLKWMGWINTYTGESTYADDFKGRFAFSLDTSASTAYLQLSS

LRSEDTAVYFCARFAIKGDYWGQGTLVTVSS**

>Anti-EpCAM scFv-v7 nt (SEQ ID NO: 473)

gatatcgtgatgacacagtcacccctgtcgctccctgtgactcccggagagcctgcgtccatctcgtgccggtc aacaaagtccctgctgcacagcgacggaattacgtatttgtactggtatttgcaaaaacccggacagagcccgc aattgttgatctaccagctctcaaaccttgcgagcggggtcccggatcgctttagctcgtcggggtcaggaact gacttcacactcaaaatctcaagggtcgaggccgaggatgaaggtgtctattactgcgctcagaatctcgaaat cccgcggacctttggttgcggtacgaagctggagatcaagcgaacgggaggcggtgggtccggtggcggtggtt ccggcggaggtggttcgggaggaggaggtagccaggtgcagcttgtccagtcgggagcagaggtaaagaagcca ggagagtcggtgaaaatctcgtgtaaagcctcggggtacacattcacgaactacggcatgaattgggtgagaca agctcccgggcagtgtttgaaatggatgggatggattaacacctacacaggggaatccacatatgcggacgact tcaaggggaggttcgcgttttcacttgatacttcagcgagcacggcgtatctccaactgtcgtcgcttcgctcc gaagataccgcagtatacttttgcgccagattcgcgattaaaggggactattggggacaggggacccttgtcac ggtgtcatcatgataa -continued >Anti-EpCAM scFv-v8 aa (SEQ ID NO: 474)

QVQLVQSGAEVKKPGESVKISCKASGYTFTNYGMNWVRQAPGQGLKWMGWINTYTGESTYADDFKGRFAFSLDT

SASTAYLQLSSLRSEDTAVYFCARFAIKGDYWGQGTLVTVSSASTGGGGSGGGGSGGGGSGGGGSDIVMTQSPL

SLPVTPGEPASISCRSTKSLLHSDGITYLYWYLQKPGQSPQLLIYQMSNLASGVPDRFSSSGSGT
*

DFTLKISRVEAEDEGVYYCAQNLEIPRTFGGGTKLEIKRT**

>Anti-EpCAM scFv-v8 nt (SEQ ID NO: 475)

caggtgcagctcgtccagtcaggggcggaggtcaagaaaccaggagagtcagtaaagatctcgtgcaaagcgtc gggatatacctttacaaactacggcatgaattgggtgcgacaagcacccggccagggcctgaagtggatggggt ggatcaatacatatactggggagtccacttatgccgacgacttcaagggaaggtttgccttctccctggatacg tcggcgtcgaccgcttatttgcagttgagctcgctgaggtcggaagatacagcagtgtacttctgcgctcgctt cgcaatcaaaggggattactggggtcaggggacgcttgtaaccgtgtcctcagcgtcgacgggtggtggtgggt cgggaggtggtggtagcggaggtggagggtcgggtggaggcggatcagatattgtgatgacacaatcgccgctc tcactgcccgtaacgcccggagagcccgcgtcaatttcatgtcggtcgacaaagtcactccttcactcggacgg gattacgtacctctattggtatcttcaaaagccgggtcagtcacctcaactcctcatctaccagatgtcgaact tggcatcaggggtccctgatcgcttctcgtccagcgggtccgggacggactttaccttgaaaatctcaagagtg gaggccgaggacgaaggggtctactactgtgcccagaaccttgaaattccgcggacgtttggaggagggacaaa gctggagatcaaaagaacttgataa >Anti-EpCAM scFv-v9 aa (SEQ ID NO: 476)

QVQLQQSGGGLVKPGESVKISCAASGYTFTNYGMNWVKQAPGKGLKWMGWINTYTGESTYADDFKGRFTFSLET

SASAAYLQINSLRPEDTAVYFCARFAIKGDYWGQGTTVTVSSASTGGGGSGGGGSGGGGSGGGGSGDIVMTQSP

SSLSASVGDKATITCRSTKSLLHSNGITYLYWYLQKPGKAPKLLIYQMSNLASGVPDRFSSSGSGTEFTLTISS

VQPEDEGTYYCAQNLEIPRTFGQGTKLEIK**

>Anti-EpCAM scFv-v9 nt (SEQ ID NO: 477)

caggtacaactccagcaatcaggaggcgggcttgtaaaacccggggagtcggtgaagatcagctgtgcagcatc agggtacacattcacaaactatggcatgaactgggtcaaacaggcgccagggaaggggctgaaatggatgggct ggatcaatacgtacactggtgagagcacatacgcggatgatttcaaagggcggtttacgttttcactcgaaacg tcggcgtccgccgcatatcttcaaatcaattccttgaggccggaggacacagcagtctacttctgcgcccgatt tgccattaagggtgattattggggccagggaaccacggtgactgtcagctccgcttcgacaggaggaggaggga gcggtggaggaggatcgggaggtggagggtcgggtggtggtgggtcaggagacattgtgatgacccagtcgccc tcgtcgctttcagcgagcgtcggggacaaggcgaccattacttgtcgctcaactaagtcgttgctgcactccaa cgggatcacgtacctctattggtatctccaaaaacctggtaaagcgcctaagctcctgatctaccagatgtcca atttggcgtcgggagtaccggacagattttcaagctccggatcagggactgagttcacacttacgattagctcc gtgcagcccgaggatgaagggacctattactgcgcccagaacttggaaatcccgagaaccttcggacagggtac gaagctggaaatcaagtgataa >Anti-EpCAM scFv-v10 aa (SEQ ID NO: 478)

QVQLQQSGGGLVKPGESVKISCAASGYTFTNYGMNWVKQAPGKGLKWMGWINTYTGESTYADDFKGRFTFSLET

SASAAYLQINSLRPEDTAVYFCARFAIKGDYWGQGTTVTVSSASTGGGGSGGGGSGGGGSGGGGSGDIVMTQSP

SSLSASVGDKATITCRSTKSLLHSDGITYLYWYLQKPGKAPKLLIYQLSNLASGVPDRFSSSGSG
* *

TEFTLTISSVQPEDEGTYYCAQNLEIPRTFGQGTKLEIK**

-continued

>Anti-EpCAM scFv-v10 nt (SEQ ID NO: 479)

caggtccagttgcaacagtccggaggtgggcttgtgaaacccggggagtcggtgaagatctcatgcgcggcttc ggggtacacgttcacaaactacgggatgaattgggtcaagcaggcacccgggaaggggttgaaatggatgggtt ggatcaatacatacactggggagagcacgtatgcagatgacttcaaaggacgctttaccttcagcctcgaaacg agcgcctcagccgcatacctccaaatcaatagcctccggccagaagatactgcggtgtatttctgcgctaggtt cgccattaaaggggactattggggacaggggacgacggtgacggtatcatcagcgtcgactggtggaggcggct ccggaggaggtgggtccggcggtggcgggtcaggtggtggtggctcgggagatattgtaatgacacagtccccg tcctccctctccgcgagcgtgggagataaggccacgattacatgtcgaagcaccaaatcgctccttcactcgga cggaatcacatatttgtattggtacttgcaaaaaccggggaaggcgcctaagctgctgatctaccagctttcga acctggcgtcaggggtccctgaccggttttcgtcgtcgggaagcgggaccgagtttacacttacgatctcgtca gtacagcccgaggacgaaggaacatactattgcgcccagaacttggagattccgagaacttttggccagggaac caagctcgaaatcaagtgataa >Anti-EpCAM scFv-v11 aa (SEQ ID NO: 480)

DIVMTQSPSSLSASVGDKATITCRSTKSLLHSNGITYLYWYLQKPGKAPKLLIYQMSNLASGVPDRFSSSGSGT

EFTLTISSVQPEDEGTYYCAQNLEIPRTFGQGTKLEIKRTGGGGSGGGGSGGGGSGGGGSGQVQLQQSGGGLVK

PGESVKISCAASGYTFTNYGMNWVKQAPGKGLKWMGWINTYTGESTYADDFKGRFTFSLETSASAAYLQINSLR

PEDTAVYFCARFAIKGDYWGQGTTVTVSS**

>Anti-EpCAM scFv-v11 nt (SEQ ID NO: 481)

gacatcgtcatgacccagtcaccgtcctcactgtcggcgtcggtgggtgataaggccacaattacatgccgcag cacgaaatcactgctccactccaatgggattacatatctctattggtatctccaaaaacccggaaaggcaccta agttgctgatctaccagatgtcgaacttggcatcgggagtacccgataggttctcgtcgtcgggaagcggcacg gagttcacgctcaccatttcctcagtccagccggaggacgaaggaacttactactgcgctcagaatcttgaaat cccgcgcacatttggacaagggacgaaacttgaaatcaagcgaactggaggaggtgggtcaggcggaggtggga gcggcggaggcggatcgggtggtggagggtcgggacaggtacagttgcagcagtcgggaggcgggctggtaaaa cctggtgaaagcgtcaagatctcatgtgcagcctcagggtatacgttcaccaattacgggatgaactgggtgaa gcaggcgccagggaaaggtcttaagtggatgggatggatcaacacttacacgggagagtccacatacgcggatg actttaaggggcggttcacgttttcgttggagacttcagcgtccgctgcctacctccaaatcaactcccttaga cccgaggacacagcggtctatttctgtgcgcggtttgccattaaaggtgattattggggacagggtacgactgt gaccgtgtccagctgataa >Anti-EpCAM scFv-v12 aa (SEQ ID NO: 482)

DIVMTQSPSSLSASVGDKATITCRSTKSLLHSDGITYLYWYLQKPGKAPKLLIYQLSNLASGVPDRFSSSG

SGTEFTLTISSVQPEDEGTYYCAQNLEIPRTFGQGTKLEIKRTGGGGSGGGGSGGGGSGGGGSGQVQLQQSGGG

LVKPGESVKISCAASGYTFTNYGMNWVKQAPGKGLKWMGWINTYTGESTYADDFKGRFTFSLETSASAAYLQIN

SLRPEDTAVYFCARFAIKGDYWGQGTTVTVSS

>Anti-EpCAM scFv-v12 nt (SEQ ID NO: 483)

gacatcgtcatgacccagtcaccgtcctcactgtcggcgtcggtgggtgataaggccacaattacatgccgcag cacgaaatcactgctccactccgacgggattacatatctctattggtatctccaaaaacccggaaaggcaccta agttgctgatctaccagttgtcgaacttggcatcgggagtacccgataggttctcgtcgtcgggaagcggcacg gagttcacgctcaccatttcctcagtccagccggaggacgaaggaacttactactgcgctcagaatcttgaaat cccgcgcacatttggacaagggacgaaacttgaaatcaagcgaactggaggaggtgggtcaggcggaggtggga gcggcggaggcggatcgggtggtggagggtcgggacaggtacagttgcagcagtcgggaggcgggctggtaaaa -continued cctggtgaaagcgtcaagatctcatgtgcagcctcagggtatacgttcaccaattacgggatgaactgggtgaa
gcaggcgccagggaaaggtcttaagtggatgggatggatcaacacttacacgggagagtccacatacgcggatg
actttaaggggcggttcacgttttcgttggagacttcagcgtccgctgcctacctccaaatcaactcccttaga
cccgaggacacagcggtctatttctgtgcgcggtttgccattaaaggtgattattggggacagggtacgactgt
gaccgtgtccagctgataa >Anti-EpCAM scFv-v13 aa (SEQ ID NO: 484)

DIVMTQSPSSLSASVGDKATITCRSTKSLLHSNGITYLYWYLQKPGKAPKLLIYQMSNLASGVPDRFSSSGSGT
EFTLTISSVQPEDEGTYYCAQNLEIPRTFGQGTKLEIKRTPSHNSHQVPSAGGPTANSGTSGSQVQLQQSGGGL
VKPGESVKISCAASGYTFTNYGMNWVKQAPGKGLKWMGWINTYTGESTYADDFKGRFTFSLETSASAAYLQINS
LRPEDTAVYFCARFAIKGDYWGQGTTVTVSS

>Anti-EpCAM scFv-v13 nt (SEQ ID NO: 485)

gacatcgtcatgacccagtcaccgtcctcactgtcggcgtcggtgggtgataaggccacaattacatgccgcag
cacgaaatcactgctccactccaatgggattacatatctctattggtatctccaaaaacccggaaaggcaccta
agttgctgatctaccagatgtcgaacttggcatcgggagtacccgataggttctcgtcgtcgggaagcggcacg
gagttcacgctcaccatttcctcagtccagccggaggacgaaggaacttactactgcgctcagaatcttgaaat
cccgcgcacatttggacaagggacgaaacttgaaatcaagcgaactccgtcccacaacagccatcaagtgccct
cggcgggagggcccaccgccaattcggggacatcagggagccaggtacagttgcagcagtcgggaggcgggctg
gtaaaacctggtgaaagcgtcaagatctcatgtgcagcctcagggtatacgttcaccaattacgggatgaactg
ggtgaagcaggcgccagggaaaggtcttaagtggatgggatggatcaacacttacacgggagagtccacatacg
cggatgactttaaggggcggttcacgttttcgttggagacttcagcgtccgctgcctacctccaaatcaactcc
cttagacccgaggacacagcggtctatttctgtgcgcggtttgccattaaaggtgattattggggacagggtac
gactgtgaccgtgtccagctgataa >Murine anti-epCAM-LC (SEQ ID NO: 486)

DIVMTQSAFS NPVTLGTSAS ISCRSTKSLL HSNGITYLYW YLQKPGQSPQ LLIYQMSNLA
SGVPDRFSSS GSGTDFTLRI SRVEAEDVGV YYCAQNLEIP RTFGGGTKLE IK

>Murine anti-epCAM-HC (SEQ ID NO: 487)

QVQLQQSGPE LKKPGETVKI SCKASGYTFT NYGMNWVKQA PGRGLKWMGW INTYTGESTY
ADDFKGRFAF SLETSASAAY LQINNLKNED TATYFCARFA IKGDYWGQGT TLTVSS

>Humanized MOC31 from WO 2000/061635

(SEQ ID NO: 488)

DIQMTQSPSSLSASVGDRVTITCRSTKSLLHSNGITYLYWYQQKPGKAPKLLIYQMSNLASGVPSRFSSSGSGT
DFTLTISSLQPEDFATYYCAQNLEIPRTFGQGTKVELKRTPSHNSHQVPSAGGPTANSGTSGSEVQLVQSGPGL
VQPGGSVRISCAASGYTFTNYGMNWVKQAPGKGLEWMGWINTYTGESTYADSFKGRFTFSLDTSASAAYLQINS
LRAEDTAVYYCARFAIKGDYWGQGTLLTVSS

>TFcBA large chain complete (SEQ ID NO: 489)

QLQLQESGPGLVKPSETLSLTCTVSGGSISSSVYYWSWIRQPPGKGLEWIGVIYPSGNTYYSPSLKSRVTISVD
TSKNQFSLKLSSVTAADTAVYYCARTIYDLFDIWGQGTMVTVSSASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCD
KTHTCPSCPAPEFLGGPSVFLFPPKPKDTLMISRTPEVTCVVVDVSQEDPEVQFNWYVDGVEVHNAKTKPREEQ
FNSKYRVVSVLTVLHQDWLNGKEYKCKVSNKGLPSSIEKTISKAKGQPREPQVYTLPPSREEMTKNQVSLSCAV
KGFYPSDIAVEWESNGQPENNYKTTPPVLDSDGSFFLVSKLTVDKSRWQQGNVFSCSVMHEALHNHYTQKSLSL
SKSCDKTGGGGSGGGGSGGGGSGGGGSGGGGSGGGGSGGGGSGGGGSCPSCPAPEFLGGPSVFLFPPKPKDTLM

-continued

```
ISRTPEVTCVVVDVSQEDPEVQFNWYVDGVEVHNAKTKPREEQFNSDYRVVSVLTVLHQDWLNGKEYKCKVSNK

GLPSSIEKTISKAKGQPREPQVYTLPPSREEMTKNQVSLWCLVKGFYPSDIAVEWESNGQPENNYKTTPPVLDS

DGSFFLYSKLTVDKSRWQQGNVFSCSVMHEALHNHYTQKSLSLSGECGGGGSGGGGSDIVMTQSPLSLPVTPGE

PASISCRSTKSLLHSDGITYLYWYLQKPGQSPQLLIYQLSNLASGVPDRFSSSGSGTDFTLKISRVEAEDEGVY

YCAQNLEIPRTFGCGTKLEIKRTGGGGSGGGGSGGGGSDIQMTQSPSSLSASVGDRVTITCRSTKSLLHSNGIT

YLYWYQQKPGKAPKLLIYQMSNLASGVPSRFSSSGSGTDFTLTISSLQPEDFATYYCAQNLEIPRTFGQGTKVE

LKRTPSHNSHQVPSAGGPTANSGTSGSEVQLVQSGPGLVQPGGSVRISCAASGYTFTNYGMNWVKQAPGKGLEW

MGWINTYTGESTYADSFKGRFTFSLDTSASAAYLQINSLRAEDTAVYYCARFAIKGDYWGQGTLLTVSS
```

Example A-14

TFcBAs

In certain embodiments, bispecific antibodies (anti-cMet/anti-EpCAM) are provided. In such embodiments, the bispecific antibodies comprise an Fab portion wherein there is a binding site with specificity for c-Met and an scFv portion wherein there is a binding site with specificity for EpCAM.

In a particular embodiment, we introduced certain stabilizing features in the scFv: (1) removal of a potential de-amidation (NG) site from CDRL1 and replaced it with DG; (2) removal of a potential methionine oxidation site from CDRL2 and replaced it with Leucine; (3) introduction of a disulfide bridge to further stabilize the VH-VL interface.

FURTHER EXAMPLES

Section B

Example B-1

Quantitative Flow Cytometry Assessment of Cell Surface Expression of Bispecific Antibody Antigens For measurements of cell surface expression of, e.g., cMet, ErbB1, ErbB2, EpCAM, CD44, and CEA levels, quantitative flow cytometry is performed using the Quantum Simply Cellular kit (Bangs Laboratories).

Cells are grown in exponential phase using standard cell culture media containing 10% FBS, and are passaged at least twice before the start of the experiment. On the day of the experiment, cells are visually assessed under a microscope to confirm between 60% and 80% confluence. Cells are detached from the culture plate by addition of 0.05% trypsin-EDTA (Gibco), and once a majority of cells are detached (as assessed visually by microscope) the trypsin is inactivated using cell culture media containing 10% FBS. The cells are centrifuged at 500 g, resuspended in flow cytometry buffer (2% FBS+0.1% sodium azide in PBS), and seeded at a density of 50,000 cells per well in a 96-well plate (BD Biosciences, catalog #62406-015).

In a separate 96-well plate, 2 drops of Quantum Simply Cellular anti-mouse IgG coated beads (Bangs Laboratories, catalog #815) or anti-human IgG coated beads (Bangs Laboratories, catalog #816) are added per well. Each bead kit contains 5 bead populations (1 blank and 4 beads with increasing levels of Fc-specific capture antibody). Each coated population binds a specific number of monoclonal antibodies of the appropriate species (the "ABC" value), and thus serves as a standard curve for quantification when beads are labeled to saturation with the same monoclonal antibody that is used to label cell surface protein.

Antibodies against the cell surface targets are given in Table B-1. For antibodies against c-Met, ErbB1, ErbB2, and CEA, conjugation with Alexa Fluor 647 (Life Technologies, catalog #A-20006) is done according to manufacturer's instructions. Antibodies against EpCAM and CD44 are available pre-conjugated with APC.

TABLE B-1

| Target | Antibody | Source |
|---|---|---|
| c-Met | 224G11-TH7-Hz3 | United States patent application 2011/0097262: SEQ ID NO 4 ($V_H$ domain), 10 ($V_L$ domain), and 28 (hinge region) |
| ErbB1 | cetuximab | Bristol-Myers Squibb/Eli Lilly |
| ErbB2 | trastuzumab | Genentech |
| EpCAM | EpCAM APC clone EBA-1 | BD Biosciences, catalog #347200 |
| CD44 | clone G44-26 APC | BD Biosciences, catalog #559942 |
| CEA | clone B6.2 | BD Biosciences, catalog #551355 |

The appropriate fluorophore-conjugated antibody is added to the cells and the beads (200 nM antibody concentration in 80 μl of flow cytometry buffer). Antibody is allowed to incubate for 30 minutes at 4° C. The plates are centrifuged and washed twice with 100 μL of ice-cold flow cytometry buffer. After the last wash, the cells and beads are centrifuged and resuspended in 100 μL of ice-cold flow cytometry buffer and read using the appropriate fluorescence filter on a flow cytometer (BD FACSCanto). Channel values for the bead populations are recorded in the bead lot-specific QuickCal template provided in the Quantum Simply Cellular kit. A regression is performed that relates fluorescence signal to the beads' ABC values. ABC values are assigned to stained cell samples using this standard curve. If monovalent antibody-to-cell surface receptor binding is presumed, then the ABC value equals the number of surface receptors.

Table B-2 lists cell surface expression levels in a panel of cell lines derived from colorectal, ovarian, lung, breast, brain, gastric, prostate, and pancreatic cancers measured using the above protocol. Table B-3 lists the ratio of expression between the various cell surface targets and c-Met. It can be seen that EpCAM has the highest median expression level of any measured target, and also the highest median expression ratio relative to c-Met, supporting the selection of EpCAM as a targeting moiety for potent bispecific antibody binding of c-Met.

In the following 2 Tables, the Tumor Types are indicated as follows: 1=colorectal, 2=ovarian, 3=non-small cell lung, 4=renal, 5=breast, 6=glioma, 7=triple-negative breast, 8=gastric, 9=epidermoid, 10=prostate, and 11=pancreatic. Cell lines indicated are commercially available, e.g., from ATCC.

TABLE B-2

| Cell Line | Tumor Type | c-Met (#/cell) | ErbB1 (#/cell) | ErbB2 (#/cell) | EpCAM (#/cell) | CD44 (#/cell) | CEA (#/cell) |
|---|---|---|---|---|---|---|---|
| HCC2998 | 1 | 8.6E+04 | 1.4E+05 | 8.6E+04 | 2.5E+06 | 5.6E+04 | 2.2E+05 |
| IGROV-1 | 2 | 1.3E+05 | 1.8E+05 | 1.5E+05 | 9.3E+02 | 1.3E+04 | 3.9E+04 |
| SW620 | 1 | 8.7E+04 | 9.9E+03 | 2.3E+04 | 1.7E+06 | 1.2E+03 | 3.0E+04 |
| H441 | 3 | 3.2E+05 | 6.6E+05 | 1.0E+05 | 2.5E+06 | 2.4E+02 | 2.7E+05 |
| ACHN | 4 | 1.3E+05 | 7.8E+05 | 5.0E+04 | 4.6E+05 | 6.4E+06 | 3.6E+04 |
| HT-29 | 1 | 9.6E+04 | 2.2E+05 | 8.6E+04 | 2.5E+06 | 9.3E+05 | 6.8E+04 |
| HCC1954 | 5 | 1.3E+05 | 2.9E+05 | 8.0E+05 | 2.4E+06 | 1.4E+06 | 4.6E+06 |
| A549 | 3 | 7.2E+04 | 3.2E+05 | 5.0E+04 | 2.4E+04 | 4.8E+06 | 3.2E+04 |
| U87 | 6 | 3.2E+04 | 2.0E+05 | 1.0E+04 | 4.0E+02 | 4.9E+06 | 1.0E+04 |
| HCT-15 | 1 | 2.3E+04 | 1.4E+05 | 6.1E+04 | 2.1E+06 | 4.0E+03 | 1.3E+04 |
| MKN45 | 8 | 1.7E+05 | 1.6E+05 | 1.0E+05 | 1.8E+06 | 3.1E+05 | 1.3E+07 |
| colo205 | 1 | 2.9E+04 | 1.0E+05 | 1.5E+05 | 2.1E+06 | 1.7E+05 | 7.4E+03 |
| U251 | 6 | 7.4E+04 | 2.9E+05 | 2.9E+04 | 2.0E+02 | 4.1E+06 | 1.7E+04 |
| HCC827 | 3 | 2.1E+05 | 1.1E+06 | 9.3E+04 | 2.1E+06 | 1.9E+05 | 8.8E+05 |
| EKVX | 3 | 4.8E+04 | 3.6E+05 | 1.1E+05 | 1.7E+04 | 2.3E+06 | 1.0E+04 |
| H1975 | 3 | 8.1E+04 | 1.5E+05 | 6.4E+04 | 2.1E+05 | 3.2E+06 | 3.4E+04 |
| H596 | 3 | 5.4E+04 | 1.7E+05 | 5.6E+04 | 2.1E+06 | 3.6E+05 | 1.3E+04 |
| JIMT | 7 | 3.7E+04 | 4.6E+05 | 2.8E+05 | 2.0E+06 | 1.4E+06 | 2.6E+04 |
| BT20 | 7 | 2.5E+04 | 1.3E+06 | 4.5E+05 | 2.3E+06 | 9.3E+05 | 6.7E+04 |
| MCF7 | 5 | 7.3E+03 | 8.7E+03 | 3.8E+04 | 2.6E+06 | 1.7E+05 | 2.8E+04 |
| Cal51 | 7 | 1.6E+04 | 7.1E+04 | 3.5E+04 | 1.2E+06 | 2.1E+06 | 1.4E+04 |
| Calu3 | 3 | 7.7E+04 | 3.2E+05 | 9.3E+05 | 2.6E+06 | 1.6E+06 | 2.5E+05 |
| SNU5 | 8 | 3.0E+05 | 2.5E+05 | 4.6E+05 | 1.9E+06 | 5.8E+04 | 7.2E+04 |
| H1993 | 3 | 6.1E+05 | 4.0E+05 | 6.5E+04 | 2.6E+06 | 4.9E+05 | 1.6E+07 |
| A431 | 9 | 2.4E+04 | 1.6E+06 | 1.5E+05 | 1.5E+06 | 1.1E+06 | 2.3E+05 |
| SkBr3 | 5 | 3.3E+04 | 3.4E+05 | 1.2E+06 | 3.0E+06 | 3.3E+03 | 1.4E+05 |
| NCI-H2170 | 3 | 5.8E+04 | 5.4E+04 | 1.2E+06 | 3.9E+06 | 1.4E+04 | 1.0E+07 |
| PC3 | 10 | 1.2E+05 | 3.1E+05 | 6.9E+04 | 7.9E+04 | 2.7E+06 | 6.9E+04 |
| H1299 | 3 | 7.4E+04 | 3.0E+05 | 5.6E+04 | 1.2E+03 | 4.3E+06 | 7.4E+04 |
| H1703 | 3 | 3.4E+04 | 5.3E+05 | 8.3E+04 | 1.2E+03 | 4.7E+02 | 3.2E+04 |
| MDA-MB 231 | 5 | 9.2E+04 | 3.5E+05 | 5.1E+04 | 3.1E+04 | 5.2E+06 | 6.1E+04 |
| BxPC3 | 11 | 1.2E+05 | 9.2E+05 | 6.6E+04 | 7.1E+05 | 5.9E+05 | 1.0E+07 |
| Cal120 | 7 | 1.3E+05 | 8.4E+05 | 1.1E+05 | 1.1E+05 | 2.1E+07 | 1.0E+06 |
| H2347 | 3 | 5.4E+05 | 9.6E+05 | 2.3E+05 | 9.2E+06 | 7.0E+05 | 6.0E+06 |
| OVCAR8 | 2 | 1.1E+05 | 7.7E+05 | 1.0E+05 | 3.4E+05 | 1.2E+07 | 8.2E+05 |
| SkOV3 | 2 | 1.6E+05 | 6.9E+05 | 2.6E+06 | 3.2E+05 | 1.1E+07 | 5.8E+05 |
| MDAMB-453 | 5 | 2.9E+04 | 5.1E+04 | 1.4E+06 | 7.5E+06 | 1.5E+03 | 4.2E+05 |
| BT474-M3 | 5 | 4.2E+04 | 2.1E+05 | 2.7E+06 | 9.2E+06 | 1.4E+03 | 4.2E+07 |
| BT549 | 5 | 2.3E+05 | 1.8E+06 | 1.3E+05 | 7.4E+03 | 2.3E+07 | 1.5E+06 |
| OVCAR3 | 2 | 1.3E+05 | 9.5E+05 | 1.7E+05 | 9.2E+06 | 4.9E+04 | 1.0E+06 |
| OVCAR-4 | 2 | 4.9E+04 | 3.3E+05 | 1.1E+05 | 2.6E+06 | 1.7E+05 | 3.1E+05 |
| OVCAR-5 | 2 | 5.5E+04 | 8.0E+05 | 9.1E+04 | 2.0E+06 | 9.9E+04 | 3.5E+06 |
| H522 | 3 | 3.1E+04 | 5.4E+04 | 1.1E+05 | 2.6E+03 | 1.1E+03 | 2.8E+05 |
| CaOV3 | 2 | 1.0E+05 | 6.3E+05 | 1.0E+05 | 2.6E+06 | 1.7E+05 | 4.9E+05 |
| SW-626 | 2 | 2.0E+05 | 4.2E+05 | 1.0E+05 | 2.6E+06 | 1.2E+05 | 4.5E+05 |
| HCT116 | 1 | 7.5E+04 | 2.1E+05 | 5.5E+04 | 2.6E+06 | 5.3E+05 | 2.1E+05 |
| HCT-8 | 1 | 4.3E+04 | 2.2E+05 | 6.2E+04 | 2.6E+06 | 6.7E+04 | 2.4E+05 |
| KM-12 | 1 | 4.0E+04 | 8.5E+04 | 6.0E+04 | 2.6E+06 | 7.2E+05 | 4.1E+05 |
| H-23 | 3 | 7.4E+04 | 2.8E+05 | 5.2E+04 | 1.6E+04 | 1.7E+06 | 5.5E+05 |
| OV-90 | 2 | 6.6E+04 | 9.8E+04 | 6.4E+04 | 2.4E+06 | 3.2E+06 | 2.2E+06 |
| OVCA-433 | 2 | 1.7E+05 | 6.9E+05 | 8.4E+04 | 2.4E+06 | 9.6E+05 | 5.6E+05 |
| TOV-112D | 2 | 2.1E+04 | 3.2E+04 | 7.7E+04 | 2.4E+03 | 0.0E+00 | 1.6E+05 |
| LoVo | 1 | 3.8E+04 | 1.6E+05 | 4.9E+04 | 2.4E+06 | 3.4E+05 | 3.0E+05 |
| LS174T | 1 | 3.4E+04 | 1.1E+05 | 7.3E+04 | 2.4E+06 | 4.6E+05 | 5.1E+05 |
| ADRr | 5 | 4.2E+04 | 2.9E+05 | 6.1E+04 | 2.0E+05 | 2.9E+06 | 2.4E+05 |
| DU145 | 10 | 4.0E+04 | 3.9E+05 | 5.8E+04 | 4.5E+05 | 2.0E+06 | 3.4E+05 |
| | Median | 7.4E+04 | 3.0E+05 | 8.6E+04 | 2.1E+06 | 5.9E+05 | 2.5E+05 |

TABLE B-3

| Cell Line | Tumor Type | ErbB1/ c-Met | ErbB2/ c-Met | EpCAM/ c-Met | CD44/ c-Met | CEA/ c-Met |
|---|---|---|---|---|---|---|
| HCC2998 | 1 | 1.6 | 1.0 | 29.1 | 0.7 | 2.6 |
| IGROV-1 | 2 | 1.4 | 1.2 | 0.0 | 0.1 | 0.3 |
| SW620 | 1 | 0.1 | 0.3 | 19.5 | 0.0 | 0.3 |
| H441 | 3 | 2.1 | 0.3 | 7.8 | 0.0 | 0.8 |
| ACHN | 4 | 6.0 | 0.4 | 3.5 | 49.2 | 0.3 |
| HT-29 | 1 | 2.3 | 0.9 | 26.0 | 9.7 | 0.7 |

TABLE B-3-continued

| Cell Line | Tumor Type | ErbB1/ c-Met | ErbB2/ c-Met | EpCAM/ c-Met | CD44/ c-Met | CEA/ c-Met |
|---|---|---|---|---|---|---|
| HCC1954 | 5 | 2.2 | 6.2 | 18.5 | 10.8 | 35.4 |
| A549 | 3 | 4.4 | 0.7 | 0.3 | 66.7 | 0.4 |
| U87 | 6 | 6.3 | 0.3 | 0.0 | 153.1 | 0.3 |
| HCT-15 | 1 | 6.1 | 2.7 | 91.3 | 0.2 | 0.6 |
| MKN45 | 8 | 0.9 | 0.6 | 10.6 | 1.8 | 76.5 |
| colo205 | 1 | 3.4 | 5.2 | 72.4 | 5.9 | 0.3 |

TABLE B-3-continued

| Cell Line | Tumor Type | ErbB1/ c-Met | ErbB2/ c-Met | EpCAM/ c-Met | CD44/ c-Met | CEA/ c-Met |
|---|---|---|---|---|---|---|
| U251 | 6 | 3.9 | 0.4 | 0.0 | 55.4 | 0.2 |
| HCC827 | 3 | 5.2 | 0.4 | 10.0 | 0.9 | 4.2 |
| EKVX | 3 | 7.5 | 2.3 | 0.4 | 47.9 | 0.2 |
| H1975 | 3 | 1.9 | 0.8 | 2.6 | 39.5 | 0.4 |
| H596 | 3 | 3.1 | 1.0 | 38.9 | 6.7 | 0.2 |
| JIMT | 7 | 12.4 | 7.6 | 54.1 | 37.8 | 0.7 |
| BT20 | 7 | 52.0 | 18.0 | 92.0 | 37.2 | 2.7 |
| MCF7 | 5 | 1.2 | 5.2 | 356.2 | 23.3 | 3.8 |
| Cal51 | 7 | 4.4 | 2.2 | 75.0 | 131.3 | 0.9 |
| Calu3 | 3 | 4.2 | 12.1 | 33.8 | 20.8 | 3.2 |
| SNU5 | 8 | 0.8 | 1.5 | 6.3 | 0.2 | 0.2 |
| H1993 | 3 | 0.7 | 0.1 | 4.3 | 0.8 | 26.2 |
| A431 | 9 | 66.7 | 6.3 | 62.5 | 45.8 | 9.6 |
| SkBr3 | 5 | 10.3 | 36.4 | 90.9 | 0.1 | 4.2 |
| NCI-H2170 | 3 | 0.9 | 20.7 | 67.2 | 0.2 | 172.4 |
| PC3 | 10 | 2.6 | 0.6 | 0.7 | 22.5 | 0.6 |
| H1299 | 3 | 4.1 | 0.8 | 0.0 | 58.1 | 1.0 |
| H1703 | 3 | 15.6 | 2.4 | 0.0 | 0.0 | 0.9 |
| MDA-MB 231 | 5 | 3.8 | 0.6 | 0.3 | 56.5 | 0.7 |
| BxPC3 | 11 | 7.7 | 0.6 | 5.9 | 4.9 | 83.3 |
| Cal120 | 7 | 6.5 | 0.8 | 0.8 | 161.5 | 7.7 |
| H2347 | 3 | 1.8 | 0.4 | 17.0 | 1.3 | 11.1 |
| OVCAR8 | 2 | 7.0 | 0.9 | 3.1 | 109.1 | 7.5 |
| SkOV3 | 2 | 4.3 | 16.3 | 2.0 | 68.8 | 3.6 |
| MDAMB-453 | 5 | 1.8 | 48.3 | 258.6 | 0.1 | 14.5 |
| BT474-M3 | 5 | 5.0 | 64.3 | 219.0 | 0.0 | 1000.0 |
| BT549 | 5 | 7.8 | 0.6 | 0.0 | 100.0 | 6.5 |
| OVCAR3 | 2 | 7.3 | 1.3 | 70.8 | 0.4 | 7.7 |
| OVCAR-4 | 2 | 6.7 | 2.2 | 53.1 | 3.5 | 6.3 |
| OVCAR-5 | 2 | 14.5 | 1.7 | 36.4 | 1.8 | 63.6 |
| H522 | 3 | 1.7 | 3.5 | 0.1 | 0.0 | 9.0 |
| CaOV3 | 2 | 6.3 | 1.0 | 26.0 | 1.7 | 4.9 |
| SW-626 | 2 | 2.1 | 0.5 | 13.0 | 0.6 | 2.3 |
| HCT116 | 1 | 2.8 | 0.7 | 34.7 | 7.1 | 2.8 |
| HCT-8 | 1 | 5.1 | 1.4 | 60.5 | 1.6 | 5.6 |
| KM-12 | 1 | 2.1 | 1.5 | 65.0 | 18.0 | 10.3 |
| H-23 | 3 | 3.8 | 0.7 | 0.2 | 23.0 | 7.4 |
| OV-90 | 2 | 1.5 | 1.0 | 36.4 | 48.5 | 33.3 |
| OVCA-433 | 2 | 4.1 | 0.5 | 14.1 | 5.6 | 3.3 |
| TOV-112D | 2 | 1.5 | 3.7 | 0.1 | 0.0 | 7.6 |
| LoVo | 1 | 4.2 | 1.3 | 63.2 | 8.9 | 7.9 |
| LS174T | 1 | 3.2 | 2.1 | 70.6 | 13.5 | 15.0 |
| ADRr | 5 | 6.9 | 1.5 | 4.8 | 69.0 | 5.7 |
| DU145 | 10 | 9.8 | 1.5 | 11.3 | 50.0 | 8.5 |
| | Median ratio | 4.1 | 1.2 | 14.1 | 7.1 | 3.8 |

Example B-2

Figure 32:
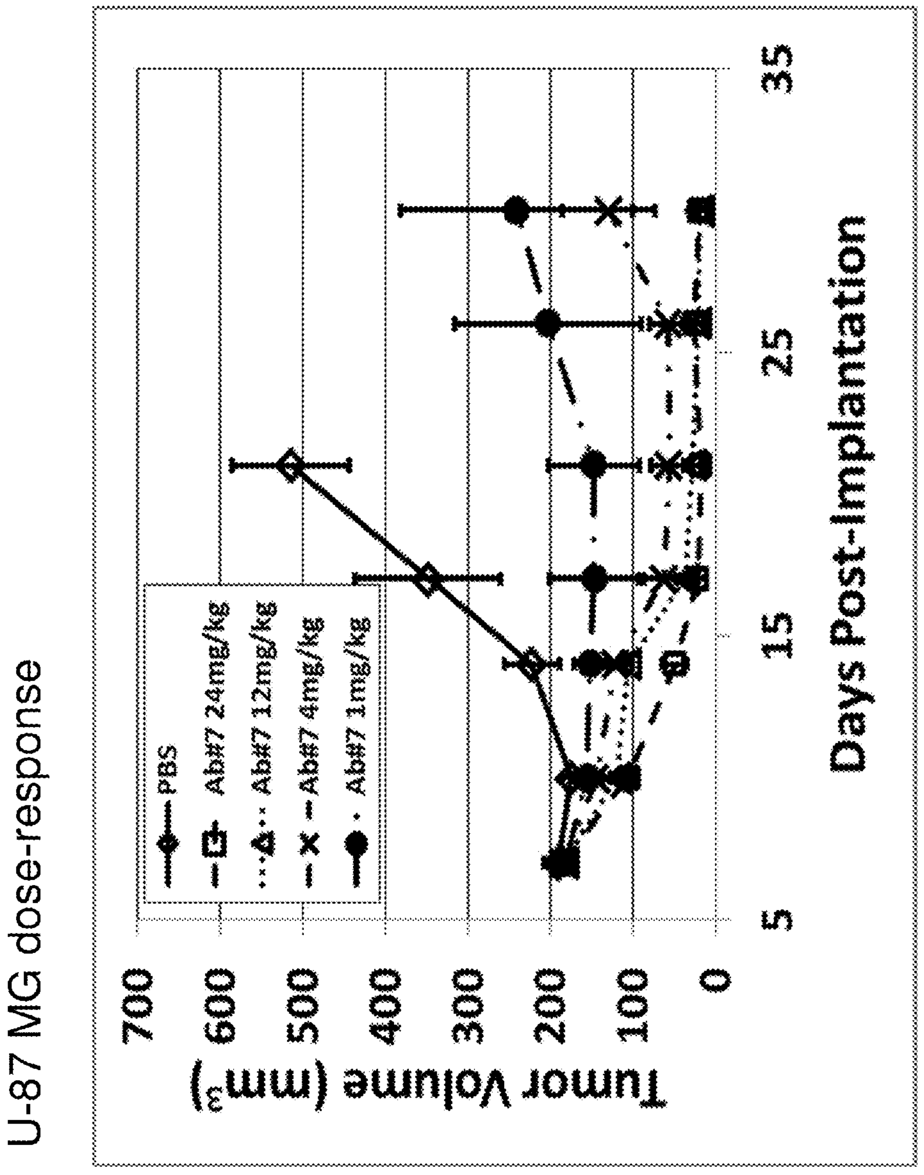
FIG. 32 is a graph showing results of dose-response analysis of antibody activity on U-87 MG tumors implanted into nude mice, as measured by post-implantation tumor volume. U-87 MG tumors were implanted subcutaneously and the mice were treated weekly with PBS control or Ab#7 at 1 mg/kg, 4 mg/kg, 12 mg/kg, or 24 mg/kg. The results show that AB#7 produces a reduction in tumor volume with a dose response correlation: increasing doses of Ab#7 yield increasing degrees of reduction of tumor volume.

Dose-Response Analysis of Antibody Activity on U-87 MG Tumors Implanted into Nude Mice The in vivo activity of Ab#7 can be further explored in the U-87 autocrine HGF model through an experiment testing the response of U-87 MG tumors to different doses of antibody. The dose-response evaluation can proceed according to the protocol described in Example A-12, except that drug is dosed every seven days. The following groups are treated:

(1) PBS control (2) Ab#7, approximately 24 mg/kg based on individual mouse body weight (3) Ab#7, approximately 12 mg/kg (4) Ab#7, approximately 4 mg/kg (5) Ab#7, approximately 1 mg/kg Data from a representative experiment conducted using the above protocol are shown in FIG. 32. Treatment with Ab#7 resulted in growth stasis of subcutaneously implanted U-87 MG tumors at the 1 mg/kg dosing level, and tumor regression at the 4 mg/kg, 12 mg/kg, and 24 mg/kg dosing levels. A dose level of equal to or higher than 12 mg/kg, given every seven days, had maximal anti-tumor activity in this experiment.

Example B-3

Creation of NCI-H358 Cell Line Variant that Secretes Human HGF (H358-HGF Cells)

Transfection of a human HGF transgene into NCI-H358 lung cancer cells (ATCC CRL-5807) may be performed using lentiviral particles (GeneCopoeia catalog #LP-A0820-Lv105-0200) according to the following protocol. NCI-H358 cells grown using standard cell culture medium supplemented with 10% fetal bovine serum (FBS) are trypsinized, counted, and seeded at a density of 10,000 cells per well in a 96-well plate, using a final volume of 100 μl. Three μl of lentiviral particles are added per well. The plate is spun in a centrifuge at 2000 rpm for 2 hours at 37° C., and then removed from the centrifuge and placed in a 37° C. incubator for 4 days. After 4 days, the media is aspirated and replaced with fresh growth media without lentivirus. After 24 hours of further incubation, the cells are trypsinized and transferred to a 24-well plate. After growth to 80% confluence, the cells are again trypsinized and transferred to a 6-well plate. After growth to 80% confluence, the media is aspirated and replaced with media containing puromycin selection antibiotic at a final concentration of 1 μg/ml. Cells are regrown in selection media until 80% confluence, after which the cells are trypsinized and pooled for expansion and later use.

Example B-4

Luminex-Based Quantification of HGF Secretion in H358-HGF Cell Line

The secretion of human HGF from cell lines may be measured using a bead-based sandwich immunoassay system (Luminex) coupled to anti-HGF antibody (R&D Systems, catalog #DY294), as described below. Preparation of beads may be performed as follows. Bio-Plex COOH beads (Bio-Rad, catalog #171-506052) are vortexed for 30 seconds, followed by bath-based sonication for an additional 30 seconds. Place 100 μl of beads into an Eppendorf tube and centrifuge at 12,000 RPM for 4 minutes. After removal of the supernatant, add 100 μl of bead wash buffer (Bio-Rad Bio-Plex Amine Coupling Kit, catalog #171-406001). Vortex and sonicate the Eppendorf tube for 10 seconds each, followed by additional centrifugation at 12,000 RPM for 4 minutes. After removal of the supernatant, resuspend the bead pellet in 80 μl of bead activation buffer (Bio-Rad Bio-Plex Amine Coupling Kit, catalog #171-406001). Vortex and sonicate the Eppendorf tube for 30 seconds each.

Immediately before use prepare 50 mg/ml solutions of both EDC carboxyl/amine crosslinker (Thermo Scientific, catalog #22980) and Sulfo-NHS ester conversion reagent (Thermo Scientific, catalog #24510). Add 10 μl of EDC solution to the Eppendorf tube, followed by 10 μl of sulfo-NHS solution. Vortex the Eppendorf for 30 seconds, cover the tube with aluminum foil to protect from light, and agitate the beads in a rotator for 20 minutes at room temperature. Add 150 μl of PBS, vortex the activated beads for 10 seconds, and then centrifuge at 12,000 RPM for 4 minutes. Remove the supernatant, and wash twice with 500 μl of PBS. Resuspend the activated beads in 100 μl antibody (1 mg/ml), followed by rotation for 2 hours at room temperature protected from light. A magnet is used to pellet the beads, so that the buffer can be removed carefully without disrupting the beads. Next, resuspend the beads in 1 ml of PBS-TBN (PBS, 0.1% BSA, 0.02% Tween-20, 0.05% Azide, pH 7.4) so that they can be stored at 4° C. in the dark until use.

Prior to use of the beads, centrifuge at 12,000 rpm for 4 minutes. Remove and discard the supernatant and wash with PBS one time and replace the supernatant with 250 μl blocking buffer (1% BSA in PBS). Vortex the beads gently for 15 seconds and then agitate using a rotator at room temperature for 30 minutes protected from light. Prepare standards for HGF using two-fold serial dilutions of recombinant protein starting at 5 ng/ml (R&D Systems, catalog #DY294). Add recombinant standard solutions and cell line supernatant to the beads and incubate overnight at 4° C. on a shaker protected from light. Dilute the detection antibody (R&D Systems, catalog #DY294) in streptavidin-PE in PBS+1% BSA to achieve a working solution of 0.001 mg/ml. Allow the beads to precipitate for 5 minutes on a magnetic plate at 4° C. Hold the plate containing the samples on the magnet firmly and invert the plate into a sink and gently blot to remove excess moisture. Centrifuge the plate briefly and add 200 μl of PBS containing 1% BSA to each well. Allow the beads to pellet on the magnet for 1-2 minutes protected from light. Repeat the above washing steps by holding the plate firmly to the magnet and inverting into the sink and adding PBS containing 1% BSA for a total of three washes. Add 100 μl of the prepared working solution of detection antibody per well. Shake gently for 1 hour protected from light. Upon completion of the incubation with detection antibody, repeat the wash steps a total of three times using PBS containing 1% BSA. Resuspend the samples in 100 μl PBS containing 1% BSA and read on the Luminex FlexMAP3D plate reader. All data is regressed to the standard curve generated using recombinant protein and then normalized based on the protein content of the cells used to generate the cell culture supernatant. Protein concentration for all cells can be performed per manufacturer's recommendation using the Thermo Scientific Pierce BCA Protein Assay (catalog #23225).

Figure 33:
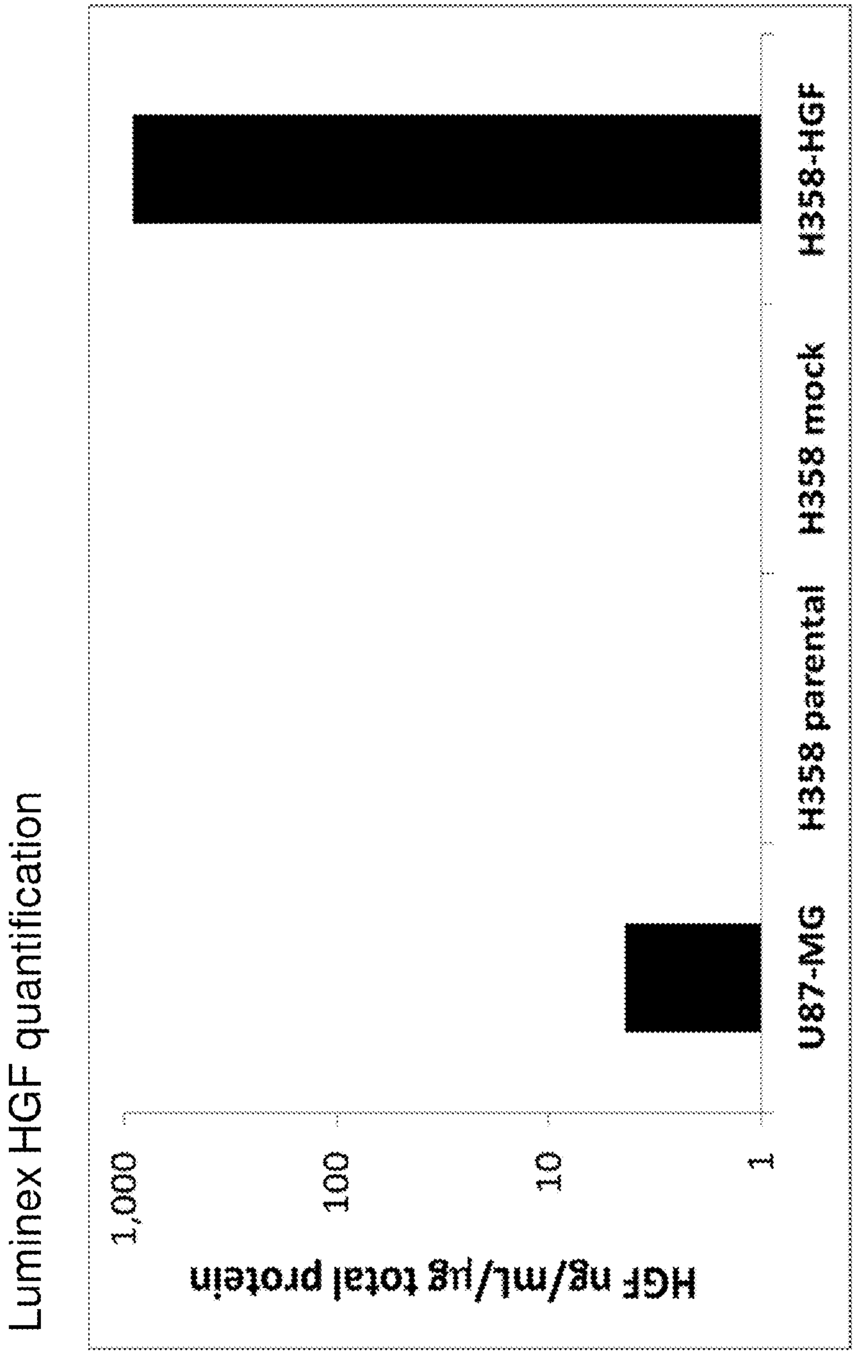
FIG. 33 is a bar graph showing results of quantification of secreted HGF from tumor cells. HGF was measured in supernatants from U-87 MG cells, NCI-H358 cells ("parental"), NCI-H358 mock-transfected cells, and NCI-H358 cells transfected with HGF and normalized against total protein.

Using the above protocol, concentration of HGF in the supernatant of cell culture media for H358-HGF and U-87 MG cells was measured and subsequently normalized to the protein concentration of cells. The H358-HGF cells demonstrated a high level of HGF secretion relative to that of U-87 MG cells that natively express autocrine HGF (FIG. 33), whereas the parental and mock-transfected H358 cells did not express detectable HGF.

Example B-5

Bispecific Antibody Activity in EpCAM-Expressing Tumor Cell Lines Implanted into Nude Mice To explore the role of tumor EpCAM expression in promoting the in vivo activity of Ab#7, the molecule can be evaluated in c-Met driven tumor models expressing EpCAM at levels significantly higher than c-Met. For HGF-ligand dependent tumor models, cell lines require autocrine secretion of human HGF, as it is known that mouse HGF does not activate human c-Met.

HCC827 cells transfected with human HGF (HCC827-HGF cells), along with mock-transfected HCC827 cells, were obtained from Dr. Jeffrey A. Engelman and were created according to the protocol described in Okamoto et al., Mol. Cancer. Ther. 9(10):2785-92. NCI-H358 cells transfected with human HGF (H358-HGF cells), and mock-transfected control cells, were created as per the protocol of Example B-3.

Quantitative flow cytometry measurements of HCC827 cell line variants demonstrated that the level of c-Met decreased in the HGF-transfected cells relative to mock-transfected parental cells ($1.2\times10^5$/cell versus $3.8\times10^5$/cell), but that the level of EpCAM was unaffected ($2.2\times10^6$/cell versus $2.2\times10^6$/cell).

Quantitative flow cytometry measurements of H358 cell line variants demonstrated that the level of c-Met remained constant in the HGF-transfected cells relative to mock-transfected parental cells ($4.6\times10^5$/cell versus $4.5\times10^5$/cell), but that the level of EpCAM was increased ($4.9\times10^7$/cell versus $3.4\times10^7$/cell).

For in vivo studies, cells are cultured in T75 flasks under a humidified atmosphere of 5% $CO_2$ at 37° C. in RPMI 1640 medium (Sigma, St. Louis, Mo.) supplemented with 10% fetal bovine serum (FBS). Cells are harvested by exposure to 0.25% trypsin. Cells are washed twice in phosphate-buffered saline (PBS) and resuspended in growth factor reduced Matrigel (BD Biosciences) at a 1:1 ratio in PBS. The cells are then counted with Trypan Blue (Life Technologies, catalog #15250-061) and mice are not implanted if the viability is <90%.

The in vivo activity of Ab#7 and OA-5D5 in these tumor models can be evaluated essentially as follows: Six-to-seven-week-old female Nu/Nu mice (Charles River Laboratories, Wilmington, Mass.) are injected subcutaneously with either $5\times10^6$ H358-HGF cells/mouse or $5\times10^6$ cells/mice HCC827-HGF using an injection volume of 200 μl PBS. Upon tumor take after injection, initial tumor volumes are measured using the following formula: $(\pi/6)*L*W^2$. The mice are sorted by weight to randomize the initial tumor volume range of 200±50 $mm^3$, at which time the animals are sorted into treatment groups of eight animals per group. Mice are treated with PBS control, bispecific antibody, or OA-5D5 by intraperitoneal injection every 7 days.

The doses of the bispecific antibody correspond to approximately 1 mg/kg, 4 mg/kg, 12 mg/kg, and 24 mg/kg based on body weight, while the dose of OA-5D5 is approximately 10 mg/kg (an equal molar level with the 12 mg/kg bispecific antibody dose). Tumor measurements and body weights are determined twice weekly throughout the study. The tumor volume is determined by measuring in two directions with fine calipers and calculated using the following formula: tumor volume=$((\pi/6)*L*W^2)$. Plotted data of tumor size represents mean and standard error of the mean for each measurement. Upon study completion, mice are euthanized and tumors from all animals are excised, flash frozen in liquid $N_2$, and stored in a −80° C. freezer.

Figure 34:
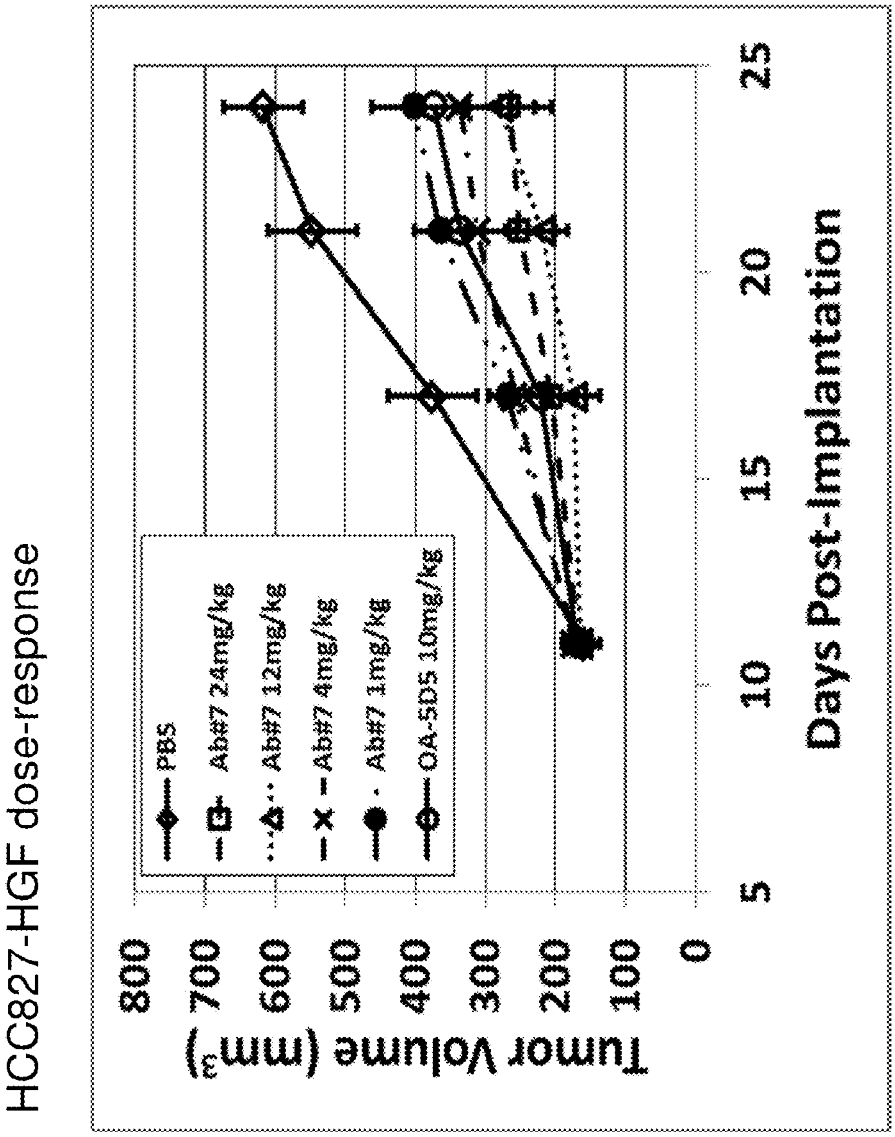
FIG. 34 is a graph showing results of dose-response analysis of antibody activity on HGF ligand-dependent HCC827-HGF tumors implanted into nude mice, as measured by post-implantation tumor volume. After tumor growth, mice were treated weekly with PBS control, Ab#7 at 1 mg/kg, 4 mg/kg, 12 mg/kg (equimolar to 10 mg/kg OA-5D5), or 25 mg/kg, or 10 mg/kg OA-5D5. Results show that Ab#7 causes greater reductions in tumor volume than does and equimolar amount of OA-5D5.

Data from a representative experiment using ligand-dependent HCC827-HGF cells in the above protocol are shown in FIG. 34. At the equimolar dosing levels of 10 mg/kg and 12 mg/kg OA-5D5 and Ab#7, respectively, the bispecific antibody had improved activity over OA-5D5. Additionally, the dose-response relationship of Ab#7 demonstrated that a dose level of equal to or higher than 12 mg/kg had maximal anti-tumor activity in this experiment. This result was in agreement to that observed in the U-87 MG model described in Example B-2.

Figure 35:
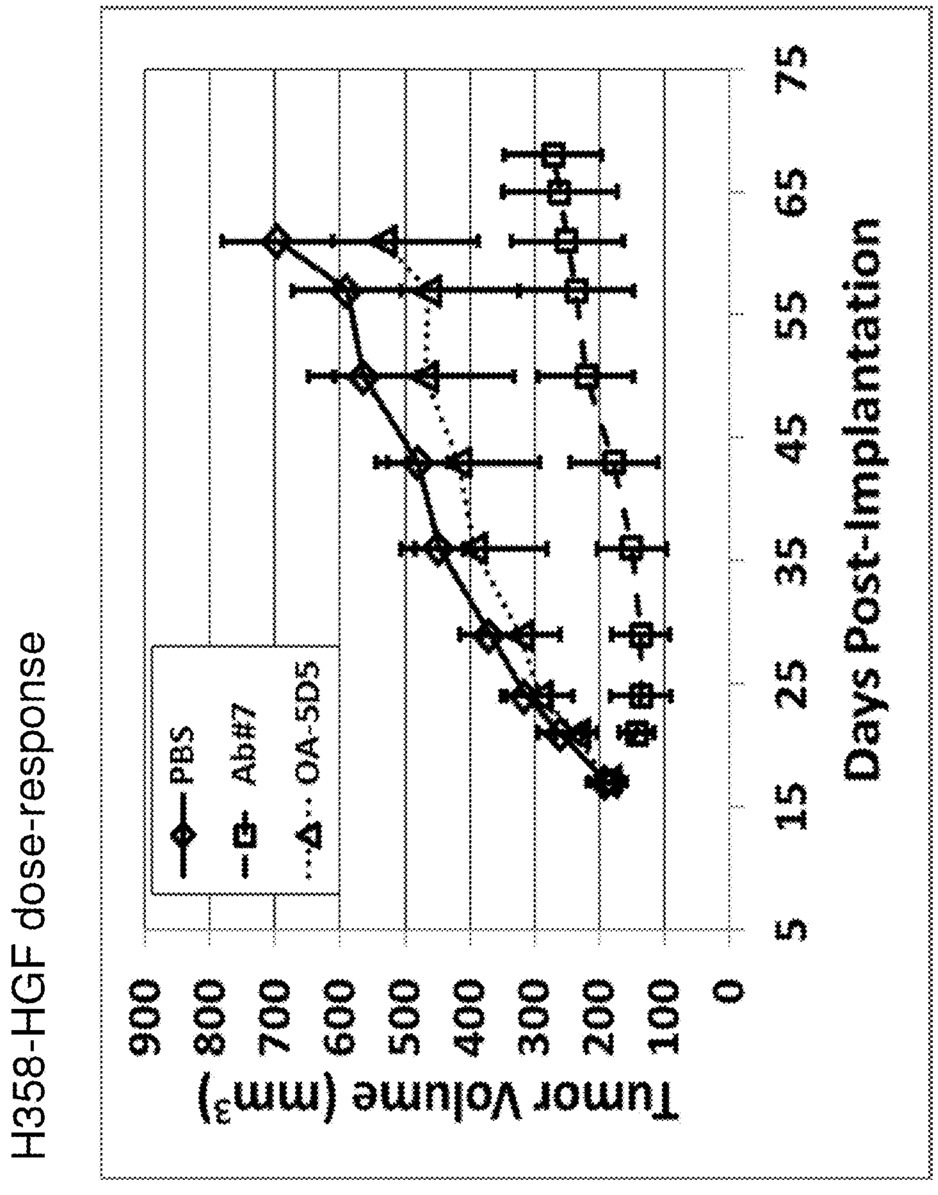
FIG. 35 is a graph showing results of antibody activity on HGF ligand-dependent H358-HGF tumors implanted into nude mice, as measured by post-implantation tumor volume. After tumor growth, mice were treated weekly with PBS control, Ab#7 at 12 mg/kg (equimolar to 10 mg/kg OA-5D5), or 10 mg/kg OA-5D5. Results show that Ab#7 causes greater reductions in tumor volume than does and equimolar amount of OA-5D5.

Data from a representative experiment using ligand-dependent H358-HGF cells in the above protocol are shown in FIG. 35. At the equimolar dosing levels of 10 mg/kg and 12 mg/kg OA-5D5 and Ab#7, respectively, the bispecific antibody caused tumor regression, whereas OA-5D5 did not meaningfully slow tumor growth relative to control.

Example B-6

Immunoblot Analysis of c-Met and EpCAM Degradation in Cell Lysates Mediated by Bispecific Antibodies The ability of antibodies to cause degradation of cellular c-Met and EpCAM can be assessed in cell lysate samples using immunoblotting as follows. A549, NCI-H441, and NCI-H2170 cells are grown to 70-80 percent confluence in 12-well plates with RPMI Media (GIBCO, catalog#1187-085) containing 10% Fetal Bovine Serum (Tissue Culture Biologicals, catalog#101H1), 2 mM L-Glutamine (GIBCO, catalog#25030-081), and penicillin/streptomycin (CellGro, catalog#30-002-CI).

Cells are then incubated with 100 nM of OA-5D5 or Ab#7 for 24 hours at 37° C., 5% $CO_2$. Upon completion of incubation, the cells are washed 2× with cold PBS and lysed in 200 μL per well of M-PER solution (VWR International, catalog #PI78505)+150 mM NaCl+protease and phosphatase inhibitor (cOmplete Protease Inhibitor Cocktail Tablet provided in EASY packs, Roche Diagnostics Corp, catalog #4693124001; PhosSTOP Phosphatase Inhibitor Cocktail Tablets, Roche Diagnostics Corp, catalog #4906837001).

Protein concentration is estimated using the Thermo Scientific Pierce BCA Protein Assay (catalog #23225) following the recommended protocol. Briefly, equal volumes of protein standards and cell lysates are incubated at a 1:20 ratio for 30 minutes at 37° C. then absorbance is measured at 562 nm. The protein concentration is estimated by regressing the standards using a linear fit and linearity of serial dilutions of the cell lysates.

For Western blot analysis, 10 μg of protein for each cell line and condition is separated via SDS-PAGE using a 10% gel. The proteins are then transferred to a PVDF membrane and blotted using total c-Met antibody (Cell Signaling, catalog #8198, 1:100 dilution), EpCAM antibody (Cell Signaling, catalog #2929, 1:100 dilution), or β-actin antibody (Cell Signaling, catalog #4970, 1:100 dilution), all used according to the manufacturer's recommendations. Goat anti-mouse IRDye 680 and goat anti-rabbit IRDye 800 (L1-COR Biosciences) were used as secondary antibodies. Immunoblots are imaged and protein levels were quantified and normalized to beta-actin levels using an Odyssey imager (L1-COR Biosciences).

Figure 36:
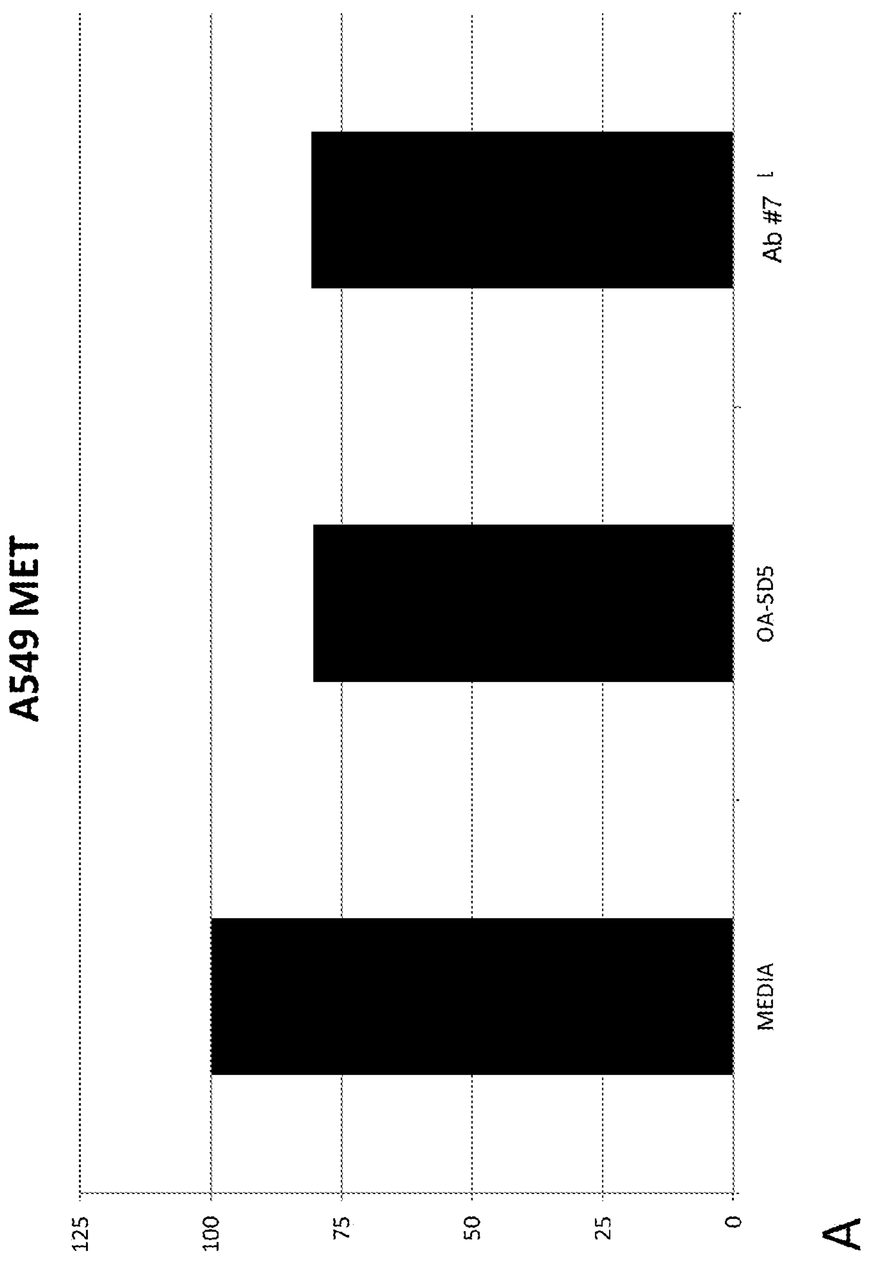
FIG. 36 provides five graphs showing protein quantitation after immunoblot analysis of c-Met and EpCAM degradation in cell lysates after treatment with bispecific antibodies. Protein was measured in cells treated with medium only, 200 nM OA-5D5, and 200 nM Ab#7. Part (A) shows quantification of c-Met in A549 cells; EpCAM was undetectable in this cell line in this experiment. Part (B) shows quantitation of c-Met in NCI-H441 cells and (D) shows quantitation of EpCAM in NCI-H441 cells. Part (C) shows quantitation of c-Met in NCI-H2170 cells and (E) shows quantitation of EpCAM in NCI-H2170 cells. Results show that Ab#7, but not OA-5D5, induces degradation of total c-Met in NCI-H441 and NCI-H2170 cells, but not in A549 cells, while none of these antibodies induced reductions in EPCAM levels in any of these cell lines.
Figure 36:
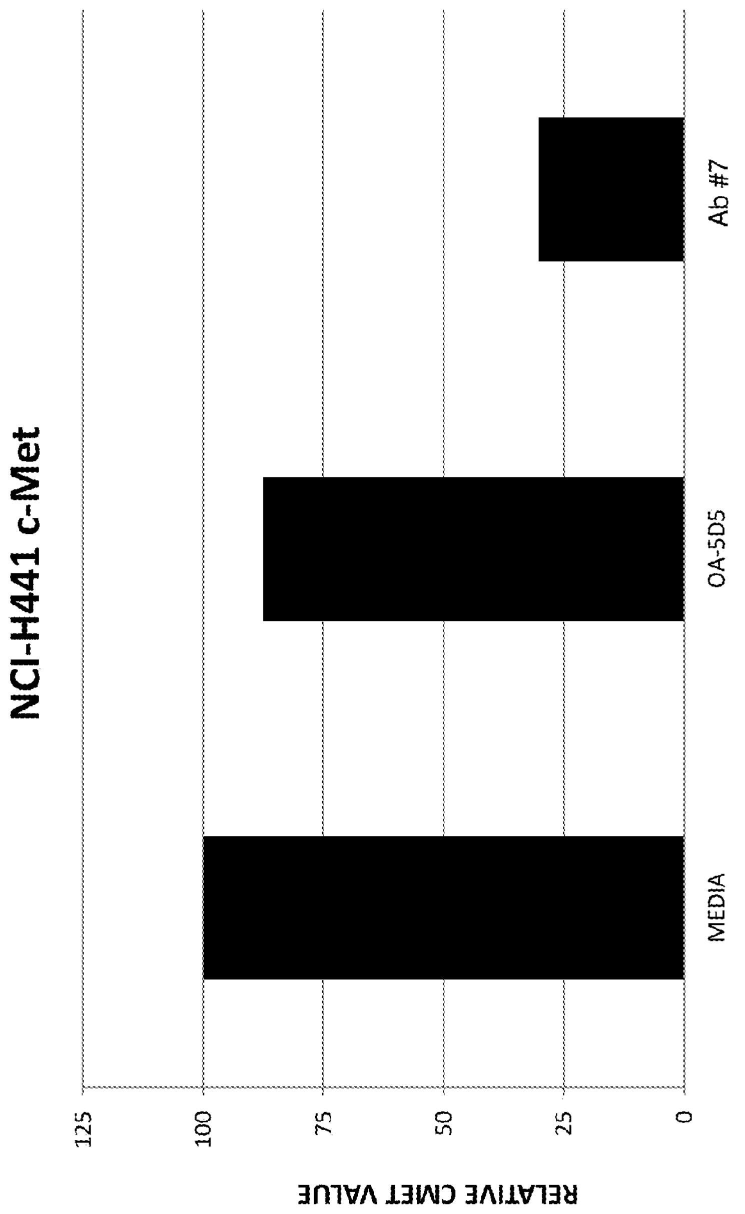
Figure 36:
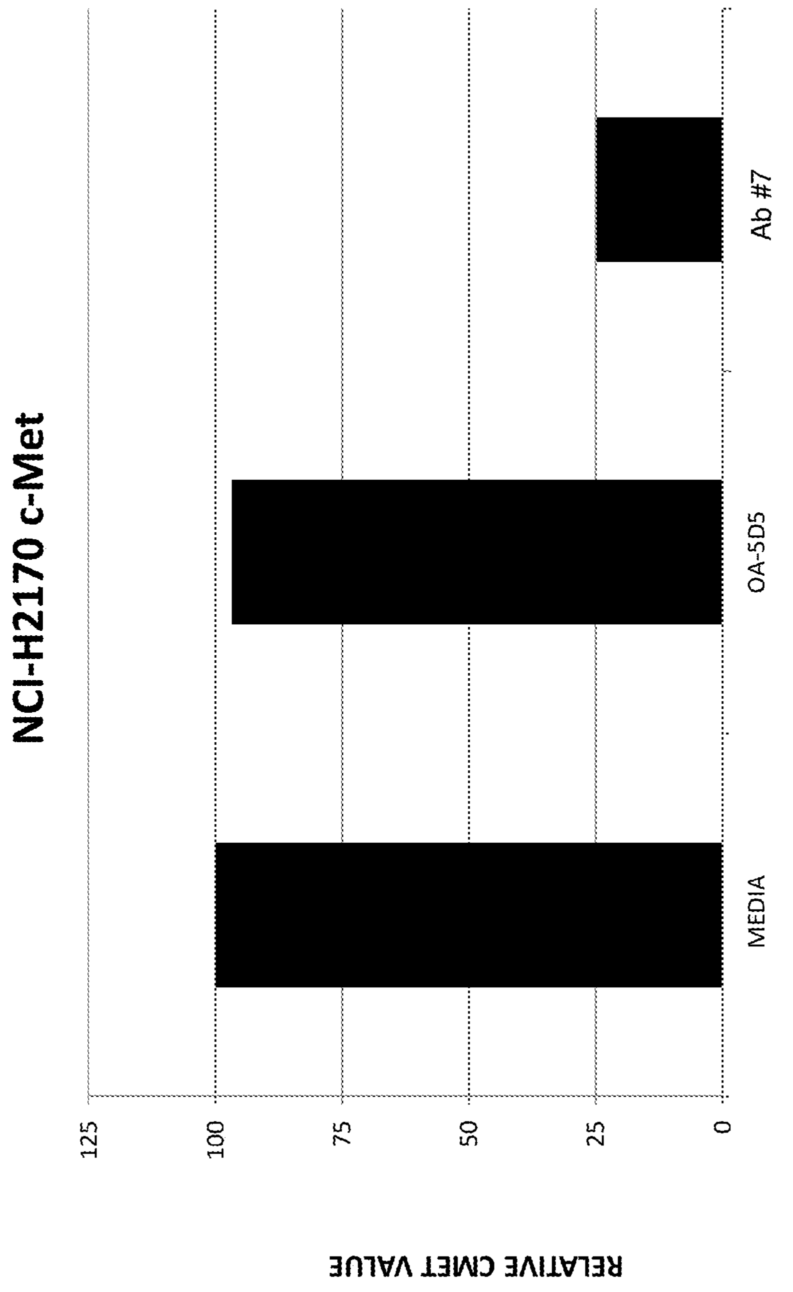
Figure 36:
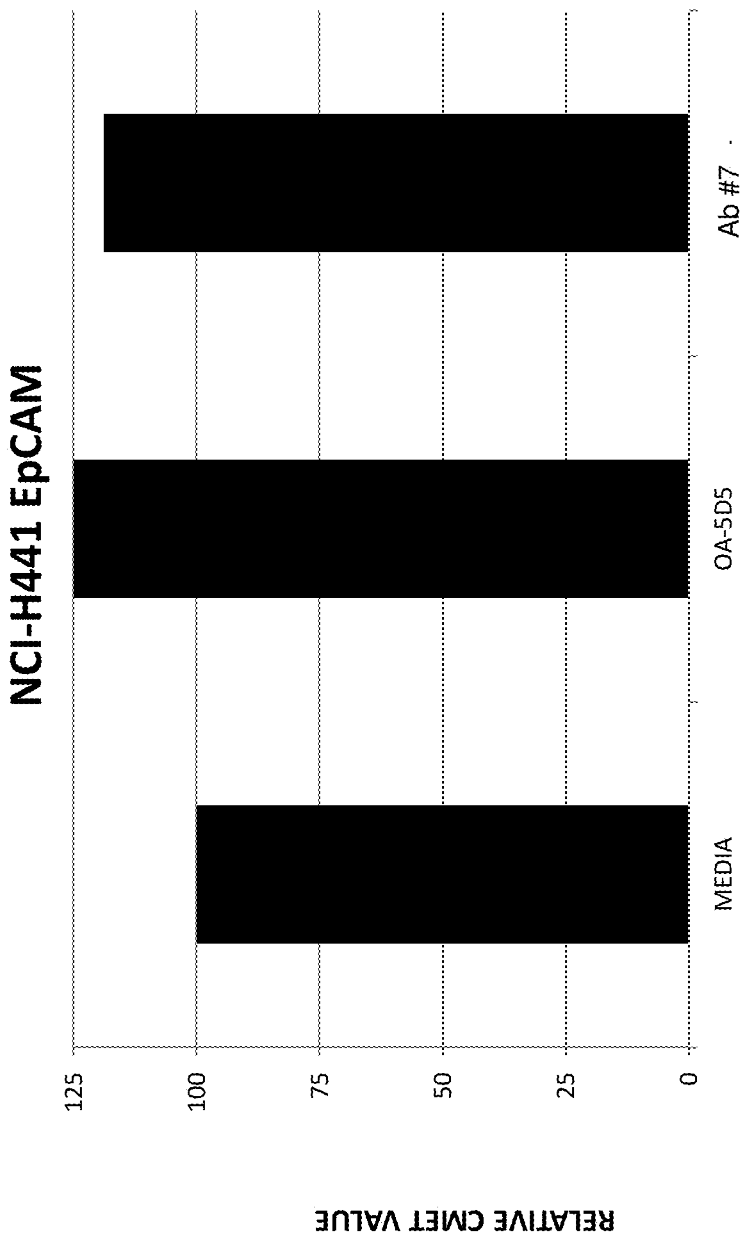
Figure 36:
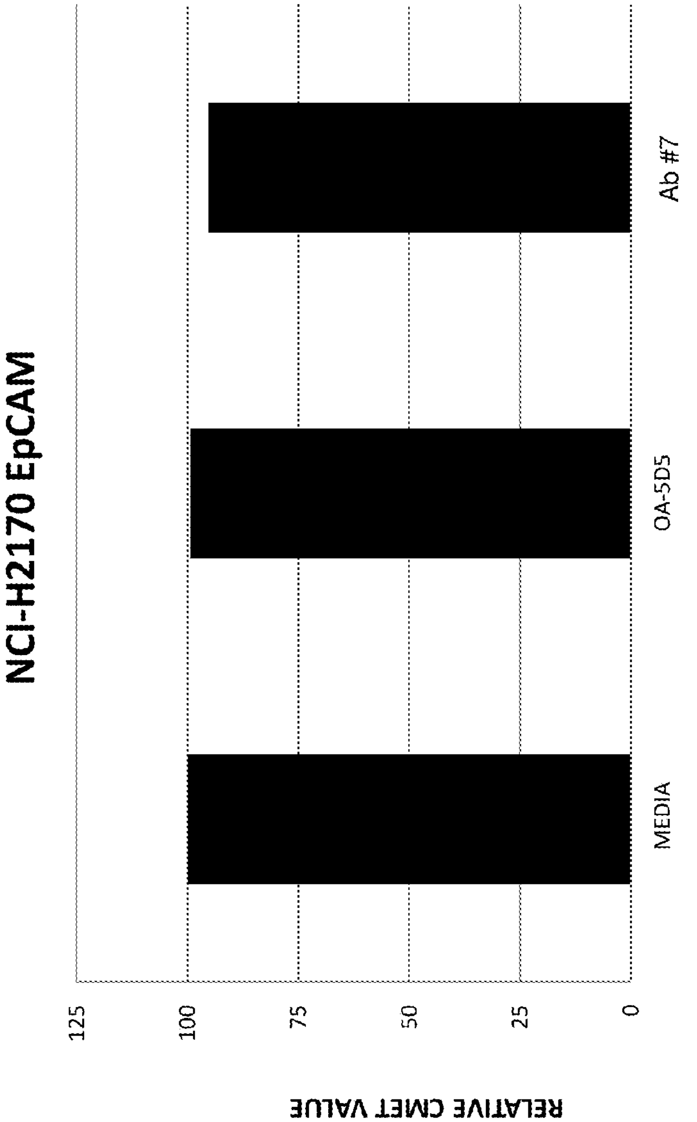

As shown in FIG. 36, A549 cells (A), NCI-H441 (B and D), and NCI-H2170 cells (C and E) were grown and incubated with 100 nM of OA-5D5 or Ab#7 as described above and the relative protein concentration of c-Met (FIG. 36, A-C) or EpCAM (D-E) was measured. EpCAM was not detectable in the A549 cells in this assay. As can be seen in FIGS. 19B and 19C, incubation with Ab#7, but not OA-5D5, caused degradation of c-Met in NCI-H441 and HCI-H2170 cells. EpCAM was not degraded in the NCI-H441 or NCI-H2170 cells, regardless of antibody treatment.

Example B-7

Immunoblot Analysis of c-Met and EpCAM Degradation in Xenograft Tumors Mediated by Bispecific Antibodies The ability of antibodies to cause degradation of cellular c-Met and EpCAM can be assessed in xenograft tumor samples using immunoblotting. To do this, tumor samples from end of study tumors from the experiments described in Example B-3 are surgically obtained and pulverized using the CryoPrep system (Covaris) according to manufacturer's instructions by placing samples in tissue tube pulverizing bags, flash freezing using liquid nitrogen, and dry pulverization at impact level 3. The freeze and pulverization steps are repeated 3-5 times depending on tissue size. Pulverized samples in tissue bags are inverted and flick-transferred to cryogenic vials (Corning) then weighed for final tumor weight of ~1-2 mg per sample. The weighed samples are then lysed for 10 minutes on ice in tissue protein extraction reagent, TPER (Thermo Scientific) with supplemented with fresh protease and phosphatase inhibitor cocktail tablet (ROCHE) for a final concentration of ~200 mg/ml per sample. Further pre-clearing centrifugation (14,000 rpm for 10 minutes) are done by using QIAshredder (QIAGEN) at 4° C. Centrifuged supernatant is removed and its total protein concentration estimated using the Thermo Scientific Pierce BCA Protein Assay (catalog #23225) per manufacturer's recommendation. Briefly, equal volumes of protein standards and cell lysates are incubated at a 1:20 ratio for 30 minutes at 37° C. then absorbance is measured at 562 nm. The protein concentration is estimated by regressing the standards using a linear fit and linearity of serial dilutions of the cell lysates.

For each immunoblot, an equal amount of total proteins are taken from individual tumor lysate samples and combined in their respective treatment groups for a total protein amount of 30 mg, which is loaded and run in 1×XT MES running buffer (BIO-RAD) on NuPAGE 4-12% Bis-Tris 10-12 well gel (Life Technology). Protein samples on the gel are transferred to nitrocellulose membrane using the iBlot gel transfer system (Invitrogen). The membrane is blocked at room temperature for 1 hour, probed with various primary antibodies overnight and secondary antibodies for one hour. All immunoblots are then washed 3× with Tris buffered Saline with Tween 20 (TTBS, Cell Signaling). Immunoblots are imaged and protein levels were quantified and normalized to beta-actin levels using an Odyssey imager (L1-COR Biosciences).

Antibodies for use in these studies include: c-Met (D1C2) XP Rabbit mAb #8198, EpCAM (D1B3) Rabbit mAb #2626, β-Actin (13E5) Rabbit mAb #4970 (all from Cell Signaling), all are used according to the manufacturer's recommendations. Goat anti-mouse IRDye 680 and goat anti-rabbit IRDye 800 (L1-COR Biosciences) are used as secondary antibodies.

Similar to the results of the in vitro experiment described above in Example B-7, tumors from mice treated with Ab #7, but not mice treated with OA-5D5, will show increased degradation of c-Met. Similarly, degradation of EpCAM will not be observed in tumors from mice treated with either Ab#7 or OA-5D5.

Additional Statements Regarding Incorporation by Reference and Variations

All references cited throughout this application, for example patent documents including issued or granted patents or equivalents; patent application publications; and non-patent literature documents or other source material; are hereby incorporated by reference herein in their entireties, as though individually incorporated by reference. Any sequence listing and sequence listing information is considered part of the disclosure herewith.

When a Markush group or other grouping of components or items is used herein, all individual members of the group and all combinations and subcombinations possible of the group are intended to be individually included in the disclosure.

As used herein, the singular forms "a", "an", and "the" include plural reference unless the context clearly dictates otherwise. Thus, for example, reference to "a cell" includes a plurality of such cells and equivalents thereof known to those skilled in the art, and so forth. As well, the terms "a" (or "an"), "one or more" and "at least one" can be used interchangeably herein. It is also to be noted that the terms "comprising", "including", and "containing" can be used interchangeably. The expression "of any of claims XX-YY" (wherein XX and YY refer to claim numbers) is intended to provide a multiple dependent claim in the alternative form, and in some embodiments is interchangeable with the expression "as in any one of claims XX-YY."

Whenever a range of values is given in the specification, for example, a temperature range, a time range, or a composition, concentration, or other value range, all intermediate ranges and subranges, as well as all individual values included in the ranges given are intended to be included in the disclosure. As used herein, ranges specifically include the values provided as endpoint values of the range. For example, a range of 1 to 100 specifically includes the end point values of 1 and 100. It will be understood that any subranges or individual values in a range or subrange that are included in the description herein can be excluded from the claims herein.

As used herein, "comprising" is synonymous with "including," "containing," or "characterized by," and is inclusive or open-ended and does not exclude additional, unrecited elements or method steps. As used herein, "consisting of" excludes any element, step, or ingredient not specified in the claim element. As used herein, "consisting essentially of" does not exclude materials or steps that do not materially affect the basic and novel characteristics of the claim. In each instance herein any of the terms "comprising", "consisting essentially of" and "consisting of" may be optionally replaced with either of the other two terms, thus describing alternative aspects of the scope of the subject matter. The invention illustratively described herein suitably may be practiced in the absence of any element or elements, limitation or limitations which is not specifically disclosed herein.

One of ordinary skill in the art will appreciate that starting materials, biological and chemical materials, biological and chemical reagents, synthetic methods, purification methods, analytical methods, assay methods, and biological methods other than those specifically exemplified can be employed in the practice of the invention without resort to undue experimentation. All art-known functional equivalents, of any such materials and methods are intended to be included in this disclosure.

The terms and expressions which have been employed herein are used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although aspects of the present invention have been specifically disclosed by various embodiments which may include preferred embodiments, exemplary embodiments and optional features, modifications and variations of the concepts herein disclosed may be resorted to by those skilled in the art. Such modifications and variations are considered to be within the scope of embodiments of the invention as described and as may be defined by the appended claims.

SEQUENCE LISTING (504 sequences)

SEQ ID NO: 1 - protein, 10 aa, Homo sapiens
EPKSCDKTHT

SEQ ID NO: 2 - protein, 5 aa, Homo sapiens
CPPCP

SEQ ID NO: 3 - protein, 6 aa, Homo sapiens
APELLG

SEQ ID NO: 4 - protein, 21 aa, Homo sapiens
EPKSCDKTHTCPPCPAPELLG

SEQ ID NO: 5 - protein, 7 aa, Homo sapiens
ERKCCVE

SEQ ID NO: 6 - protein, 7 aa, Homo sapiens
APPVAGP

SEQ ID NO: 7 - protein, 19 aa, Homo sapiens
ERKCCVECPPCPAPPVAGP

SEQ ID NO: 8 - protein, 12 aa, Homo sapiens
ELKTPLGDTTHT

SEQ ID NO: 9 - protein, 50 aa, Homo sapiens
CPRCPEPKSCDTPPPCPRCPEPKSCDTPPPCPRCPEPKSCDTPPPCPRCP

SEQ ID NO: 10 - protein, 6 aa, Homo sapiens
APELLG

SEQ ID NO: 11 - protein, 68 aa, Homo sapiens
ELKTPLGDTTHTCPRCPEPKSCDTPPPCPRCPEPKSCDTPPPCPRCPEPKSCDTPPPCPRCPAPELLG

SEQ ID NO: 12 - protein, 7 aa, Homo sapiens
ESKYGPP

SEQ ID NO: 13 - protein, 5 aa, Homo sapiens
CPSCP

SEQ ID NO: 14 - protein, 6 aa, Homo sapiens
APEFLG

SEQ ID NO: 15 - protein, 18 aa, Homo sapiens
ESKYGPPCPSCPAPEFLG

SEQ ID NO: 16 - protein, 10 aa, Artificial Sequence
  Description of Artificial Sequence: Synthetic peptide
EPKSCDKTCC

SEQ ID NO: 17 - protein, 10 aa, Artificial Sequence
  Description of Artificial Sequence: Synthetic peptide
EPKSCDKCHT

SEQ ID NO: 18 - protein, 21 aa, Artificial Sequence
  Description of Artificial Sequence: Synthetic peptide
EPKSCDKTCCCPPCPAPELLG

SEQ ID NO: 19 - protein, 21 aa, Artificial Sequence [sequence omitted]

SEQ ID NO: 20 - protein, 21 aa, Artificial Sequence [sequence omitted]

SEQ ID NO: 21 - protein, 21 aa, Artificial Sequence
  Description of Artificial Sequence: Synthetic peptide
EPKSCDKTCCCPSCPAPEFLG

SEQ ID NO: 22 - protein, 21 aa, Artificial Sequence
  Description of Artificial Sequence: Synthetic peptide
EPKSCDKCHTCPSCPAPEFLG

SEQ ID NO: 23 - protein, 11 aa, Artificial Sequence
  Description of Artificial Sequence: Synthetic peptide
CPPCPAPELLG

SEQ ID NO: 24 - protein, 11 aa, Artificial Sequence
  Description of Artificial Sequence: Synthetic peptide
CPSCPAPEFLG

SEQ ID NO: 25 - protein, 104 aa, Artificial Sequence
  Description of Artificial Sequence: Synthetic polypeptide
GPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAK

SEQ ID NO: 26 - protein, 104 aa, Artificial Sequence
  Description of Artificial Sequence: Synthetic polypeptide
GPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAK

SEQ ID NO: 27 - protein, 107 aa, Homo sapiens
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 106 aa, Homo sapiens [sequence omitted]

SEQ ID NO: 29 - protein, 107 aa, Homo sapiens
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 106 aa, Homo sapiens
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 31 - protein, 107 aa, Artificial Sequence
  Description of Artificial Sequence: Synthetic polypeptide
GQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 32 - protein, 106 aa, Artificial Sequence
  Description of Artificial Sequence: Synthetic polypeptide
GQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 33 - protein, 107 aa, Artificial Sequence
  Description of Artificial Sequence: Synthetic polypeptide
GQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 34 - protein, 106 aa, Artificial Sequence
  Description of Artificial Sequence: Synthetic polypeptide
GQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 35 - protein, 107 aa, Artificial Sequence
  Description of Artificial Sequence: Synthetic polypeptide
GQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 106 aa, Artificial Sequence
  Description of Artificial Sequence: Synthetic polypeptide
GQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 37 - protein, 107 aa, Artificial Sequence
  Description of Artificial Sequence: Synthetic polypeptide
GQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 106 aa, Artificial Sequence
  Description of Artificial Sequence: Synthetic polypeptide
GQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 39 - protein, 107 aa, Artificial Sequence
  Description of Artificial Sequence: Synthetic polypeptide
GQPREPQVYTLPPSRDELTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 40 - protein, 106 aa, Artificial Sequence
  Description of Artificial Sequence: Synthetic polypeptide
GQPREPQVYTLPPSRDELTKNQVSLTCLVKGFYPSDIAVEWESNGQPENNYKTTPPVLDSDGSFFLTSKLTVDKSRWQQGNVFSCSVMHEALHNHYTQKSLSLSPG

SEQ ID NO: 41 - protein, 107 aa, Artificial Sequence
  Description of Artificial Sequence: Synthetic polypeptide
GQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 42 - protein, 106 aa, Artificial Sequence
  Description of Artificial Sequence: Synthetic polypeptide
GQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPG

SEQ ID NO: 43 - protein, 107 aa, Artificial Sequence
  Description of Artificial Sequence: Synthetic polypeptide
GQPREPQVYTLPPSRDELTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 106 aa, Artificial Sequence
  Description of Artificial Sequence: Synthetic polypeptide
GQPREPQVYTLPPSRDELTKNQVSLYCLVKGFYPSDIAVEWESNGQPENNYKTTPPVLDSDGSFFLYSKLTVDKSRWQQGNVFSCSVMHEALHNHYTQKSLSLSPG

SEQ ID NO: 45 - protein, 107 aa, Artificial Sequence
  Description of Artificial Sequence: Synthetic polypeptide
GQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 106 aa, Artificial Sequence
  Description of Artificial Sequence: Synthetic polypeptide
GQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPG

SEQ ID NO: 47 - protein, 107 aa, Artificial Sequence
  Description of Artificial Sequence: Synthetic polypeptide
GQPREPQVYTLPPSRDELTKNQVHLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 48 - protein, 106 aa, Artificial Sequence
  Description of Artificial Sequence: Synthetic polypeptide
GQPREPQVYTLPPSRDELTKNQVHLTCLVKGFYPSDIAVEWESNGQPENNYKTTPPVLDSDGSFALYSKLTVDKSRWQQGNVFSCSVMHEALHNHYTQKSLSLSPG

SEQ ID NO: 49 - protein, 107 aa, Artificial Sequence
  Description of Artificial Sequence: Synthetic polypeptide
GQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 50 - protein, 106 aa, Artificial Sequence
  Description of Artificial Sequence: Synthetic polypeptide
GQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPG

SEQ ID NO: 51 - protein, 107 aa, Artificial Sequence
  Description of Artificial Sequence: Synthetic polypeptide
GQPREPQVTTLPPSRDELTKNQVSLTCLVKGFYPSDIAVEWESNGQPENNYKTFPPVLDSDGSFFLYSKLTVDKSRWQQGNVFSCSVMHEALHNHYTQKSLSLSPGK

SEQ ID NO: 52 - protein, 106 aa, Artificial Sequence
  Description of Artificial Sequence: Synthetic polypeptide
GQPREPQVTTLPPSRDELTKNQVSLTCLVKGFYPSDIAVEWESNGQPENNYKTFPPVLDSDGSFFLYSKLTVDKSRWQQGNVFSCSVMHEALHNHYTQKSLSLSPG

SEQ ID NO: 53 - protein, 107 aa, Artificial Sequence
  Description of Artificial Sequence: Synthetic polypeptide
GQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSPGK

SEQ ID NO: 54 - protein, 106 aa, Artificial Sequence
  Description of Artificial Sequence: Synthetic polypeptide
GQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSPG

SEQ ID NO: 55 - protein, 107 aa, Artificial Sequence
  Description of Artificial Sequence: Synthetic polypeptide
GQPREPQVYTLPPSRDELTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 56 - protein, 106 aa, Artificial Sequence
  Description of Artificial Sequence: Synthetic polypeptide
GQPREPQVYTLPPSRDELTKNQVSLTCLVDGFYPSDIAVEWESNGQPENNYDTTPPVLDSDGSFFLYSDLTVDKSRWQQGNVFSCSVMHEALHNHYTQKSLSLSPG

SEQ ID NO: 57 - protein, 107 aa, Artificial Sequence
  Description of Artificial Sequence: Synthetic polypeptide
GQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 58 - protein, 106 aa, Artificial Sequence
  Description of Artificial Sequence: Synthetic polypeptide
GQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPG

SEQ ID NO: 59 - protein, 107 aa, Artificial Sequence
  Description of Artificial Sequence: Synthetic polypeptide
GQPREPQVYTLPPSRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 60 - protein, 106 aa, Artificial Sequence
  Description of Artificial Sequence: Synthetic polypeptide
GQPREPQVYTLPPSRKKLTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 61 - protein, 107 aa, Artificial Sequence
  Description of Artificial Sequence: Synthetic polypeptide
GQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 62 - protein, 106 aa, Artificial Sequence
  Description of Artificial Sequence: Synthetic polypeptide
GQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 63 - protein, 107 aa, Artificial Sequence
  Description of Artificial Sequence: Synthetic polypeptide
GQPREPQVCTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 106 aa, Artificial Sequence
  Description of Artificial Sequence: Synthetic polypeptide
GQPREPQVCTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 65 - protein, 107 aa, Artificial Sequence
  Description of Artificial Sequence: Synthetic polypeptide
GQPREPQVCTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 106 aa, Artificial Sequence
  Description of Artificial Sequence: Synthetic polypeptide
GQPREPQVCTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 67 - protein, 107 aa, Artificial Sequence
  Description of Artificial Sequence: Synthetic polypeptide
GQPREPQVYTLPPCRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 106 aa, Artificial Sequence
  Description of Artificial Sequence: Synthetic polypeptide
GQPREPQVYTLPPCRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 69 - protein, 107 aa, Artificial Sequence; identical to SEQ ID NO: 67
  Description of Artificial Sequence: Synthetic polypeptide

SEQ ID NO: 70 - protein, 106 aa, Artificial Sequence; identical to SEQ ID NO: 68
  Description of Artificial Sequence: Synthetic polypeptide

SEQ ID NO: 71 - protein, 110 aa, Artificial Sequence
  Description of Artificial Sequence: Synthetic polypeptide
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 72 - protein, 110 aa, Artificial Sequence
  Description of Artificial Sequence: Synthetic polypeptide
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 73 - protein, 107 aa, Artificial Sequence
  Description of Artificial Sequence: Synthetic polypeptide
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSGEC

SEQ ID NO: 74 - protein, 107 aa, Artificial Sequence
  Description of Artificial Sequence: Synthetic polypeptide
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSGEC

SEQ ID NO: 75 - protein, 107 aa, Artificial Sequence
  Description of Artificial Sequence: Synthetic polypeptide
GQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 76 - protein, 106 aa, Artificial Sequence
  Description of Artificial Sequence: Synthetic polypeptide
GQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 77 - protein, 107 aa, Artificial Sequence
  Description of Artificial Sequence: Synthetic polypeptide
GQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 78 - protein, 106 aa, Artificial Sequence
  Description of Artificial Sequence: Synthetic polypeptide
GQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 79 - protein, 107 aa, Artificial Sequence
  Description of Artificial Sequence: Synthetic polypeptide
GQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 106 aa, Artificial Sequence
  Description of Artificial Sequence: Synthetic polypeptide
GQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 81 - protein, 107 aa, Artificial Sequence
  Description of Artificial Sequence: Synthetic polypeptide
GQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 106 aa, Artificial Sequence
  Description of Artificial Sequence: Synthetic polypeptide
GQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 110 aa, Artificial Sequence
  Description of Artificial Sequence: Synthetic polypeptide
GQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 84 - protein, 110 aa, Artificial Sequence
  Description of Artificial Sequence: Synthetic polypeptide
GQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 85 - protein, 107 aa, Artificial Sequence
  Description of Artificial Sequence: Synthetic polypeptide
GQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 86 - protein, 107 aa, Artificial Sequence
  Description of Artificial Sequence: Synthetic polypeptide
GQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 87 - protein, 107 aa, Artificial Sequence
  Description of Artificial Sequence: Synthetic polypeptide
GQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 88 - protein, 107 aa, Artificial Sequence
  Description of Artificial Sequence: Synthetic polypeptide
GQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 89 - protein, 110 aa, Artificial Sequence
  Description of Artificial Sequence: Synthetic polypeptide
GQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 90 - protein, 110 aa, Artificial Sequence
  Description of Artificial Sequence: Synthetic polypeptide
GQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 91 - protein, 110 aa, Artificial Sequence
  Description of Artificial Sequence: Synthetic polypeptide
GQPREPQVYTLPPSRDELTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 92 - protein, 110 aa, Artificial Sequence
  Description of Artificial Sequence: Synthetic polypeptide
GQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 93 - protein, 107 aa, Artificial Sequence
  Description of Artificial Sequence: Synthetic polypeptide
GQPREPQVTTLPPSRDELTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 94 - protein, 107 aa, Artificial Sequence
  Description of Artificial Sequence: Synthetic polypeptide
GQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 95 - protein, 110 aa, Artificial Sequence
  Description of Artificial Sequence: Synthetic polypeptide
GQPREPQVYTLPPSRDELTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 96 - protein, 110 aa, Artificial Sequence
  Description of Artificial Sequence: Synthetic polypeptide
GQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 97 - protein, 107 aa, Artificial Sequence
  Description of Artificial Sequence: Synthetic polypeptide
GQPREPQVYTLPPSRKKLTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 98 - protein, 107 aa, Artificial Sequence
  Description of Artificial Sequence: Synthetic polypeptide
GQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 99 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 102 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 105 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 106 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 109 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 110 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 113 - protein, 232 aa, Artificial Sequence
  Description of Artificial Sequence: Synthetic polypeptide
EPKSCDKTCCCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 114 - protein, 222 aa, Artificial Sequence; identical to SEQ ID NO: 102
  Description of Artificial Sequence: Synthetic polypeptide

SEQ ID NO: 115 - protein, 232 aa, Artificial Sequence
  Description of Artificial Sequence: Synthetic polypeptide
EPKSCDKCHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 116 - protein, 222 aa, Artificial Sequence; identical to SEQ ID NO: 102
  Description of Artificial Sequence: Synthetic polypeptide

SEQ ID NO: 117 - protein, 235 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 118 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 119 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 120 - protein, 225 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 121 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 122 - protein, 225 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 123 - protein, 235 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 124 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 125 - protein, 235 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 126 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 127 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 128 - protein, 225 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 129 - protein, 235 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 130 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 131 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 132 - protein, 225 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 133 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 136 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 139 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 140 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 143 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 144 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 147 - protein, 232 aa, Artificial Sequence
  Description of Artificial Sequence: Synthetic polypeptide
EPKSCDKTCCCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 148 - protein, 222 aa, Artificial Sequence; identical to SEQ ID NO: 136
  Description of Artificial Sequence: Synthetic polypeptide

SEQ ID NO: 149 - protein, 232 aa, Artificial Sequence
  Description of Artificial Sequence: Synthetic polypeptide
EPKSCDKCHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 150 - protein, 222 aa, Artificial Sequence; identical to SEQ ID NO: 136
  Description of Artificial Sequence: Synthetic polypeptide

SEQ ID NO: 151 - protein, 235 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 152 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 153 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 154 - protein, 225 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKT

SEQ ID NO: 155 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 156 - protein, 225 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 157 - protein, 235 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 158 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGEC

SEQ ID NO: 159 - protein, 235 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 160 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 161 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 162 - protein, 225 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKT

SEQ ID NO: 163 - protein, 235 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 164 - protein, 222 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 165 - protein, 232 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 166 - protein, 225 aa, Artificial Sequence
  Description of Artificial Sequence: Synthetic polypeptide
CPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKT

SEQ ID NO: 167 - protein, 6 aa, Artificial Sequence
  Description of Artificial Sequence: Synthetic peptide
KSCDKT

SEQ ID NO: 168 - protein, 3 aa, Artificial Sequence
  Description of Artificial Sequence: Synthetic peptide
GEC

SEQ ID NO: 169 - protein, 40 aa, Artificial Sequence
  Description of Artificial Sequence: Synthetic polypeptide
TRPAPPSTATTAGSTPQPESASPSGKEPAASSPSSTNTGS

SEQ ID NO: 170 - DNA, 1482 bp, Artificial Sequence
  Description of Artificial Sequence: Synthetic polynucleotide
gaaccgaaatcatgcgataagacccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaa

SEQ ID NO: 171 - protein, 494 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - DNA, 1482 bp, Artificial Sequence
  Description of Artificial Sequence: Synthetic polynucleotide
gaaccgaaatcatgcgataaaactcacacgtgccctccatgccctgctccggaacttctcgggggaccgtccgtattcctctttcctcctaagcctaaggacaccctcatgatcagcaggacccccgaggtgacgtgtgtagtcgtggatgtgtcccacgaggacccggaagtcaagttcaactggtatgtagatggagtggaggtccataatgccaagaccaagccaagagaggagcagtatcagtcgacttatcgggtggtcagcgtcctcacggtacttcatcaggattggctgaatggaaaggagtacaaatgtaaggtatccaacaaagcgttgccagcgcccatcgaaaagacaatctcgaaggcgaagggacaaccccgggaaccgcaagtgtgtaccctgccaccttcccgggaggagatgacgaaaaaccaggtatccctgtcgtgcgccgtgaaagggttttacccatcggatatcgcagtggagtgggaaagcaatgggcagccggaaaacaactataagaccacgccccctgtactcgactcggatgggtcctttttcctcgtcagcaaacttacggtagacaaaagcaggtggcaacaggggaatgtgttcagctgctcagtcatgcacgaggcactccataaccattacactcagaaatcactgtcgctgtcgcccggtaaagggggaggtgggtcgggcggtgggggaagcggtggtgggggatcaggtgggggaggttcgggaggtggtgggagcggtggaggcggttccggaggaggcgggtcgggtggaggtggatcgtgcccaccgtgccccgcaccggaactccttgggggaccatccgtgtttctgtttccaccgaagccaaaggacactctcatgatctcgcgcacaccagaggtgacatgtgtcgtcgtcgatgtgtcacacgaagatccagaggtcaagtttaactggtacgtggacggagtcgaggtccacaatgcgaaaacgaaacccagagaagagcagtaccagtcaacataccgggtggtgagcgtattgaccgtgcttcaccaggactggcttaacgggaaagagtacaagtgtaaggtcagcaataaggcgctcccagcgcctattgagaaaactatctcgaaagcaaaggggcagccacgagagccccaagtgtgtacgctgccaccctgtcgggaggaaatgaccaagaatcaagtctcgctttggtgccttgtgaagggattctatcccagcgacattgctgtagagtgggagtcgaacgggcaacccgagaataactacaagactactccgccggtgttggactcggacgggtcgttcttcctttatagcaaactcacagtcgacaagtccagatggcagcagggaaatgtcttttcctgctcggtaatgcacgaagcgttgcataaccactatacacagaagtcgctttcgttgtcacccgggaaa

SEQ ID NO: 173 - protein, 494 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - DNA, 1482 bp, Artificial Sequence
  Description of Artificial Sequence: Synthetic polynucleotide
gaaccgaaatcatgcgacaaaacgcacacttgtccgccgtgccctgccccagagttgcttggaggaccatcagtatttctcttccctcctaagccgaaagacacactcatgatctcacgcacaccggaagtaacttgcgtggtggtggatgtgtcgcatgaagatcccgaggtcaaattcaactggtacgtcgacggtgtggaggtgcacaacgccaagacgaaacccagagaagagcagtatcagtcgacctaccgagtggtatccgtgcttacggtgctgcatcaggattggttgaatggaaaagaatacaaatgcaaagtctcgaataaggcgctcccagccccaatcgaaaagacgatttccaaggcgaaggggcagcctcgggaacctcaggtctatacccttcctccgtcacgcgaggaaatgacaaagaatcaggtcagcctcacatgcctcgtgaagggattctatccgtcggatattgctgtcgagtgggaatcgaacggacagcccgagaacaattacaaaacaactcctcccgtacttgactcggacgggagctttttccttacgtcaaagctgaccgtcgataaaagcaggtggcagcaagggaatgtgttttcgtgctcggtcatgcacgaagcacttcataaccactacacccagaaatccttgagcctgtcaccggggaagggaggagggggtagcggcggtggagggagcggaggaggcgggtccggtgggggtgggtccgggggtggcggaagcggtggcggaggttcgggagggggaggaagcggagggggtggatcgtgtcctccgtgcccagcccccgaactcctcgggggaccctcggtattcctttttccgccgaaacccaaggacactttgatgattagccggacgcccgaggtgacatgcgtggtcgtggatgtatcgcatgaggaccccgaagtgaagttcaattggtacgtggatggggtggaagtccataacgcaaagaccaagcccagagaggagcagtaccaatcgacgtatagggtcgtgtccgtcctcacagtcttgcaccaggactggttgaacgggaaggagtataagtgtaaggtcagcaacaaagcgttgcctgcgcccattgaaaagactatctcaaaagcaaagggacagcccagggagccccaagtgtacacactgcccccgtcaagagaagaaatgaccaaaaatcaagtgtccctctactgcttggtgaaggggttctatcccagcgacatcgcggtagagtgggagtcaaatggccagcccgaaaacaactacaaaacgacaccgcccgtgttggattcggatgggtcattctttctgtattcaaaactgacagtggacaagtcgcggtggcaacaggggaacgtgttttcctgttccgtaatgcacgaggcgttgcacaatcactatacgcagaagtccctctcgctttcacccgggaag

SEQ ID NO: 175 - protein, 494 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - DNA, 1482 bp, Artificial Sequence
  Description of Artificial Sequence: Synthetic polynucleotide
gaaccgaaatcatgcgataagacttgctgctgtcctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaatcaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaa

SEQ ID NO: 177 - protein, 494 aa, Artificial Sequence
  Description of Artificial Sequence: Synthetic polypeptide
EPKSCDKTCCCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - DNA, 1482 bp, Artificial Sequence
  Description of Artificial Sequence: Synthetic polynucleotide
gaaccgaaatcatgcgataagtgccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaa

SEQ ID NO: 179 - protein, 494 aa, Artificial Sequence
  Description of Artificial Sequence: Synthetic polypeptide
EPKSCDKCHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - DNA, 1491 bp, Artificial Sequence
  Description of Artificial Sequence: Synthetic polynucleotide
gaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgc

SEQ ID NO: 181 - protein, 497 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 182 - DNA, 1422 bp, Artificial Sequence
  Description of Artificial Sequence: Synthetic polynucleotide
gaaccgaaatcatgcgacaagacccacacctgcccaccgtgtccagcgcccgagctcctcggagggccgtcggtgttcctctttcccccaaagcctaaagacactctgatgatcagccgcactccagaagtgacatgtgtggtggtggatgtctcgcatgaggacccggaagtcaaattcaattggtacgtggatggtgtcgaagtgcacaacgccaagacaaaaccgcgcgaggagcagtaccagagcacctaccgggtggtatcagtgcttacagtactgcatcaggattggctgaacggaaaggagtacaagtgtaaagtcagcaacaaagcgctcccggctccgatcgagaaaacgatctcaaaggccaagggccagccgcgagaaccccaagtatacacgttgcccccttcaagggaggaaatgaccaagaatcaggtgtcactgagctgcgccgtcaagggattctacccctcggacattgcagtagagtgggagtcgaatgggcaacccgaaaacaactataagacgacacccccggtcctcgactcagatggatcgttcttccttgtatcaaaattgacggtcgacaagagccggtggcagcaaggtaacgtattttcgtgttcggtgatgcatgaagcgctgcataaccactatacgcagaagagcttgtccttgtcaccaggcaagggaggtgggggttcgggcggaggaggtagcggcggagggggtagcggaggtggcgggtcctgtcccccgtgccccgcaccggagctgctgggaggtccgtcagtgtttttgtttcctcccaagccgaaagacacgctgatgatctcgaggacgcccgaggtaacgtgcgtcgtcgtcgatgtatcccacgaagatcccgaggtcaagttcaactggtatgtagatggggtcgaagtccataacgctaagacaaagccgagagaggaacaatatcagtcaacttatcgggtcgtgtcggtcctgaccgtacttcaccaggactggctcaatgggaaagagtacaaatgcaaggtgtccaataaggcgctgcctgcgccaattgagaaaactatctcgaaagcgaagggacagcccagagagccgcaagtatatacactgccaccctcgagagaagaaatgacgaagaatcaagtctccttgtggtgtttggtgaaggggttttacccttcagacatcgcagtggaatgggaatcgaacgggcagccagaaaacaattacaaaaccacacctcctgtccttgactccgatggctcatttttcctctattcgaagctcactgtcgacaagtcgcgctggcagcagggtaacgtctttagctgctccgtgatgcacgaggccctccacaatcattatacacagaaatcgctgtcactttcgcccggaaaa

SEQ ID NO: 183 - protein, 474 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - DNA, 1476 bp, Artificial Sequence
  Description of Artificial Sequence: Synthetic polynucleotide
gaaccgaaatcatgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggaagcggaggcggagggagcggaggtggtgggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 185 - protein, 492 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 186 - DNA, 1476 bp, Artificial Sequence
  Description of Artificial Sequence: Synthetic polynucleotide
gaaccgaaatcatgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcggggaatgcggagggggagggtccgggggtggtgggagcggcggaggaggtagcggcggaggtggctcgggaggaggtgggtcgggtggtgggggaagcggaggcggagggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgaagtcatgcgacaagact

SEQ ID NO: 187 - protein, 492 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 188 - DNA, 1461 bp, Artificial Sequence
  Description of Artificial Sequence: Synthetic polynucleotide
gaaccgaaatcatgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggaagcggaggcggagggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 189 - protein, 487 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 190 - DNA, 1446 bp, Artificial Sequence
  Description of Artificial Sequence: Synthetic polynucleotide
gaaccgaaatcatgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggatcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 191 - protein, 482 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 192 - DNA, 1491 bp, Artificial Sequence
  Description of Artificial Sequence: Synthetic polynucleotide
gaaccgaaatcatgcgacaaaacgcacacttgtccgccctgccctgcgcccgaactgcttggaggcccttcggtgtttttgtttccgcccaagcctaaggacaccttgatgatcagccggacaccggaggtcacatgtgtcgtcgtggatgtctcgcacgaggatcccgaggtcaagtttaactggtatgtggatggagtggaggtccacaacgccaaaaccaagcccagggaggagcaataccagtcaacctatcgggtagtctcggtgctgacggtactgcaccaggactggttgaatggaaaagagtacaaatgcaaggtatcaaacaaggcccttcccgctcccatcgaaaagacgatcagcaaagcgaaagggcaacccagagagccccaagtctatacgctgcctccctcaagggaagaaatgacgaaaaaccaggtgcacttgacatgcctcgtgaaaggcttctacccgagcgacattgcggtggaatgggagtcaaatggtcagccggaaaacaactacaagacaactccaccggtccttgattcagacgggtcgttcgccctctatagcaaactcacggtcgacaagtcccgctggcagcagggtaacgtgttttcgtgttcagtgatgcacgaggctctgcataatcactacacacagaagtccctctccttgagcaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtcccccttgtccagcgccggagctgttgggcggaccttcggtattcttgtttcctcctaagcccaaagatacgcttatgatctcccgcaccccggaggtaacttgcgtcgtagtggatgtatcacatgaggacccagaagtcaagttcaattggtacgtggacggagtcgaagtccataacgctaaaacgaaaccgagagaggaacagtatcagagcacctaccgggtagtgagcgtgctcacagtgttgcatcaggattggctgaatgggaaggaatacaagtgcaaagtgtcgaataaggcattgccagcaccgattgagaaaacaatctcaaaagcgaagggacagccccgagagcctcaagtcactacactgccacccagccgcgaagagatgacaaagaatcaggtatccctcacgtgtcttgtgaaggggttctatccctccgatatcgcagtagagtgggaatcgaacgggcagccggagaacaattacaagactttcccgccagtgcttgattcggacggtagcttctttttgtattcgaagctcacggtagataagtcgaggtggcaacaaggaaatgtgttttcatgttcggtgatgcatgaagcgctccataaccactatacgcagaaatcgctttcgctctccggtgaatgc

SEQ ID NO: 193 - protein, 497 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 194 - DNA, 1491 bp, Artificial Sequence
  Description of Artificial Sequence: Synthetic polynucleotide
gaaccgaaatcatgcgacaaaacgcacacttgtccgccgtgcccagcgcccgagttgcttggcggacccagcgtgtttttgtttcccccgaaaccgaaagatacattgatgattagcagaacgcccgaagtgacgtgtgtagtagtcgacgtgtcgcacgaagatccggaggtgaagttcaactggtatgtcgatggggtagaggtgcacaacgcgaaaaccaagcccagggaggagcagtaccagtcgacatatcgggtcgtgtcagtgctgacagtgctccatcaggactggttgaacgggaaggagtataagtgtaaagtcagcaacaaagccctccccgcacccatcgagaaaaccatttccaaggcaaagggacaaccgagggaaccacaagtctacactctcccaccctcccgcgaagaaatgacgaaaaaccaagtgtcactgacgtgtcttgtagatggtttctacccctcggacatcgcggtcgaatgggagtcgaatggacagccggagaacaattacgataccacacctcctgtcttggattcggacggctcattcttcctttacagcgatctcactgtcgacaagtcgcgctggcagcagggaaacgtcttttcctgttcggtaatgcacgaagctctgcacaatcactacacgcagaagtcgctttcactttccaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtcccccttgtccagcgccggagctgttgggcggaccttcggtattcttgtttcctcctaagcccaaagatacgcttatgatctcccgcaccccggaggtaacttgcgtcgtagtggatgtatcacatgaggacccagaagtcaagttcaattggtacgtggacggagtcgaagtccataacgctaaaacgaaaccgagagaggaacagtatcagagcacctaccgggtagtgagcgtgctcacagtgttgcatcaggattggctgaatgggaaggaatacaagtgcaaagtgtcgaataaggcattgccagcaccgattgagaaaacaatctcaaaagcgaagggacagccccgagagcctcaagtctatacactgccgccaagccggaagaagatgaccaaaaaccaggtgtccctcacgtgcctcgtgaaagggttttacccgtcagatatcgccgtagaatgggagagcaatgggcagcccgagaataactataagactacgccccctgtactcaaatcggacgggtcattctttctgtattcgaagctcacggtagataagtcgaggtggcaacaaggaaatgtgttttcatgttcggtgatgcatgaagcgctccataaccactatacgcagaaatcgctttcgctctccggtgaatgc

SEQ ID NO: 195 - protein, 497 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 196 - DNA, 1372 bp, Artificial Sequence
  Description of Artificial Sequence: Synthetic polynucleotide
gaaccgaaatcatgcgacaagacccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagctta

SEQ ID NO: 197 - protein, 494 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 1482 bp, Artificial Sequence
  Description of Artificial Sequence: Synthetic polynucleotide
gaaccgaaatcatgcgataagacacacacgtgcccctcgtgccccgcaccggagttccttgggggtccgtcggtctttttgtttccccctaaacccaaggacacgctcatgatctcccgcacaccggaagtcacgtgcgtagtcgtggatgtctcacaagaggacccggaagtgcaattcaactggtacgtcgacggcgtggaggtgcacaatgccaagacgaaaccaagagaggaacagttcaactcaaagtaccgggtagtatcggtgttgacggtgctccatcaggattggcttaacggtaaagagtacaagtgtaaagtcagcaataagggtctgcccagctccatcgaaaagactatctccaaggccaaggggcagcctcgcgaaccgcaagtgtgtacgttgcccccgtcccgggaggagatgacgaaaaatcaggtcagcctctcgtgtgcggtgaaggggttttacccatccgacattgcggtggaatgggagagcaacggacagcccgaaaacaattacaagactaccccgccagtactcgatagcgacgggtcgttctttcttgtgtcgaaactgacagtggacaagtcaagatggcagcaaggaaatgtgttctcgtgtagcgtgatgcacgaggcactccacaatcattacacacagaagagcttgtccctctcccctggtaaaggaggaggagggtcgggtgggggaggcagcgggggaggaggatcaggaggtgggggttcaggcggagggggttcgggtggtgggggatcgggaggtggaggttcgggaggagggggctcctgtccgagctgccccgctcccgagttcttgggaggtccctcagtgtttcttttcccgccgaagcctaaagatacactgatgatttcacgaacccccgaagtgacatgcgtagtagtagatgtgtcgcaagaagatccggaagtccagttcaattggtatgtggatggggtggaggtccataatgcgaaaacaaaaccgcgggaagagcaattcaattcaaagtatagggtcgtcagcgtgctcacagtgctgcaccaggactggcttaatgggaaagaatacaagtgcaaggtatccaacaaggggttgccctcgtcgatcgagaaaacgatttcaaaagccaagggacaaccgagggaaccacaagtatgcacgctgccgccgtgtagggaagaaatgacgaagaaccaagtgagcctctggtgcctggtgaagggcttttatccctccgacatcgcagtcgagtgggaatcgaatgggcagccggagaacaactataagactactcccccagtgttggattcggatggatcatttttcctctactcgaaacttacggtcgacaaatcacgctggcagcagggcaacgtgttttcctgctcggtaatgcatgaggcgcttcacaaccactatacccagaagtcactgtcgcttagcccagggaaa

SEQ ID NO: 199 - protein, 494 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - DNA, 1482 bp, Artificial Sequence
  Description of Artificial Sequence: Synthetic polynucleotide
gaaccgaaatcatgcgacaagacccatacgtgcccatcgtgccccgcaccggagttcctcggaggcccgtcagtattcctttttcctccgaagcccaaagatacattgatgatcagcaggacgcctgaagtgacatgtgtagtggtagacgtgtcgcaagaagatccagaggtacagtttaactggtatgtcgacggggtggaagtccataacgccaagactaaaccccgcgaagagcagttcaactcaaagtatagagtagtctccgtcctgacagtcctccatcaggactggctgaacgggaaagaatacaagtgcaaagtctcgaacaaagggcttccgtcatcgatcgagaaaacgatttcaaaagccaagggacagcctagggagccgcaagtgtatactctgcccccgtcgcgcgaggagatgacgaaaaatcaggtgtccctcacgtgcctcgtcaaaggattttacccgtcggatatcgccgtggagtgggaatcgaatgggcaaccagagaacaactacaagaccactcccccggtgctggactcggacggctcctttttcttgacatcaaagctcacagtcgataagagccgctggcaacaagggaatgtgttcagctgctcggtgatgcacgaagcgctgcacaaccactatacccagaaatcattgtccctcagccccggaaagggaggtggagggtccggtgggggtggatcaggagggggtgggagcggaggaggcggcagcggtggcggagggtcaggtggaggcggatcaggtgggggaggttcaggcggtgggggctcgtgccccagctgtcctgctcccgagtttctcgggggaccttcagtctttctcttccctccgaaacccaaggacacgctgatgatttcgcggacacccgaagtgacttgtgtcgtggtcgacgtaagccaggaggaccccgaggtgcaattcaactggtacgtcgacggagtcgaggtccacaatgcgaaaacaaaacccagagaagaacagttcaattcgaaatatcgagtggtatcagtcctgaccgtgcttcatcaggattggctcaatgggaaagagtacaaatgcaaggtatcaaacaagggactgccaagctcaatcgaaaagactatctcgaaagcaaagggtcagcctcgggagccccaagtgtacacgcttcccccatccagggaagaaatgacgaagaaccaggtgtcgctctactgtttggtgaaggggttttatccttcggacatcgcggtggaatgggagtcgaatggacagccggagaataactacaaaacgactccgcctgtcctcgacagcgatgggtccttcttcctttactcaaaattgacagtagataagtcgcgctggcagcagggaaatgtattctcctgttccgtcatgcatgaggcgcttcacaatcactacactcagaagtccttgtcgttgtcaccaggaaaa

SEQ ID NO: 201 - protein, 494 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - DNA, 1482 bp, Artificial Sequence
  Description of Artificial Sequence: Synthetic polynucleotide
gaaccgaaatcatgcgacaagacatgctgttgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgactaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaa

SEQ ID NO: 203 - protein, 494 aa, Artificial Sequence
  Description of Artificial Sequence: Synthetic polypeptide
EPKSCDKTCCCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - DNA, 1482 bp, Artificial Sequence
  Description of Artificial Sequence: Synthetic polynucleotide
gaaccgaaatcatgcgacaagtgccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaa

SEQ ID NO: 205 - protein, 494 aa, Artificial Sequence
  Description of Artificial Sequence: Synthetic polypeptide
EPKSCDKCHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - DNA, 1491 bp, Artificial Sequence
  Description of Artificial Sequence: Synthetic polynucleotide
gaaccgaaatcatgcgataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcgaagtatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcaaatacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgc

SEQ ID NO: 207 - protein, 497 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 208 - DNA, 1422 bp, Artificial Sequence
  Description of Artificial Sequence: Synthetic polynucleotide
gaaccgaaatcatgcgacaagacccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttcctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaa

SEQ ID NO: 209 - protein, 474 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - DNA, 1476 bp, Artificial Sequence
  Description of Artificial Sequence: Synthetic polynucleotide
gaaccgaaatcatgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcgggtggtgggggaagcggaggcggagggtcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 211 - protein, 492 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 212 - DNA, 1476 bp, Artificial Sequence
  Description of Artificial Sequence: Synthetic polynucleotide
gaaccgaaatcatgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgggggaatgcggagggggagggtccggagggggagggtccgggggtggtgggagcggcggaggaggtagcggcggaggtggctcgggaggaggtgggtcgggtggtgggggatcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgaagtcatgcgacaagact

SEQ ID NO: 213 - protein, 492 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 214 - DNA, 1461 bp, Artificial Sequence
  Description of Artificial Sequence: Synthetic polynucleotide
gaaccgaaatcatgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcgggtggtgggggatcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 215 - protein, 487 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 216 - DNA, 1446 bp, Artificial Sequence
  Description of Artificial Sequence: Synthetic polynucleotide
gaaccgaaatcatgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgt

SEQ ID NO: 217 - protein, 482 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 218 - DNA, 1491 bp, Artificial Sequence
  Description of Artificial Sequence: Synthetic polynucleotide
gaaccgaaatcatgcgacaaaacgcacacttgtccttcctgccctgccccggagttccttggcggaccctcggtctttttgtttccgccgaaaccgaaagacacccttatgattagcaggacacccgaagtcacgtgtgtcgtcgtggacgtgtcgcaagaggatcccgaggtgcagttcaactggtacgtggacggggtagaagtccacaatgccaagacaaaaccccgggaagaacagtttaactcgaagtaccgcgtagtgtcagtcttgacagtcctccatcaggactggcttaacgggaaggagtacaaatgtaaagtgtcaaacaagggtctgccttccagcattgagaaaacgatctccaaggctaaagggcagccccgagaaccacaagtctatacgcttccaccatcgcgggaggagatgaccaagaaccaggtccacttgacctgtctcgtgaaggggttctacccgtcagatatcgcggtagagtgggaatcgaacggccagcccgagaataactacaagacgactcctccggtcctcgattcagatgggtcgttcgcactctactcaaaacttacggtggacaagtcgagatggcagcagggcaacgtgtttagctgctcagtcatgcacgaggcgctgcataatcactatacacagaagtcgctgtcattgtcaaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtccgtcgtgccctgcaccggaattcttgggcggtccgtcagtgttcctgtttcccccgaaacccaaagatacgctcatgatttcccgcacccctgaggtcacttgcgtggtagtcgatgtcagccaggaagatcccgaagtacagttcaattggtacgtagatggtgtagaagtacacaacgctaaaactaagcctcgcgaagagcagttcaattcgaagtatcgggtagtaagcgtgctgactgtgctccatcaagactggctgaatggaaaagagtataagtgcaaagtctcgaataagggattgcccagctccatcgagaaaaccatctcgaaagcgaagggacagcccagagaaccccaagtgaccacattgccaccctcccgagaggaaatgactaagaatcaagtgtcactcacatgtcttgtgaagggattctatcccagcgacatcgccgtcgagtgggagtccaatgggcagccggaaaacaattacaaaacgtttccacccgtccttgactcagatggatcgttctttctctattcgaagctcacggtagataagtcgaggtggcaacaaggaaatgtgttttcatgttcggtgatgcatgaagcgctccataaccactatacgcagaaatcgctttcgctctccggtgaatgc

SEQ ID NO: 219 - protein, 497 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 220 - DNA, 1491 bp, Artificial Sequence
  Description of Artificial Sequence: Synthetic polynucleotide
gaaccgaaatcatgcgacaaaacgcacacttgtccttcctgccctgccccggagttccttggcggaccctcggtctttttgtttccgccgaaaccgaaagacacccttatgattagcaggacacccgaagtcacgtgtgtcgtcgtggacgtgtcgcaagaggatcccgaggtgcagttcaactggtacgtggacggggtagaagtccacaatgccaagacaaaaccccgggaagaacagtttaactcgaagtaccgcgtagtgtcagtcttgacagtcctccatcaggactggcttaacgggaaggagtacaaatgtaaagtgtcaaacaagggtctgccttccagcattgagaaaacgatctccaaggctaaaggacagccaagagagcctcaagtctatacattgcccccgagccgggaggaaatgaccaaaaaccaggtatcgcttacgtgcttggtggacgggttttacccttcagacatcgcagtggagtgggaatccaacgggcagccagagaacaattacgataccactccacccgtgcttgacagcgatggctcattcttcctctattccgacttgaccgtcgataagtcacgatggcagcaggggaatgtgtttagctgttcggtcatgcacgaagcgctgcacaaccactacacgcagaagtcgctctcattgtccaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtccgtcgtgccctgcaccggaattcttgggcggtccgtcagtgttcctgtttcccccgaaacccaaagatacgctcatgatttcccgcacccctgaggtcacttgcgtggtagtcgatgtcagccaggaagatcccgaagtacagttcaattggtacgtagatggtgtagaagtacacaacgctaaaactaagcctcgcgaagagcagttcaattcgaagtatcgggtagtaagcgtgctgactgtgctccatcaagactggctgaatggaaaagagtataagtgcaaagtctcgaataagggattgcccagctccatcgagaaaaccatctcgaaagcgaagggacagcccagagaaccccaagtgtatacgcttcccccttcaagaaagaagatgactaagaatcaggtgtcactcacgtgcctcgtgaagggattctatccgtcggacatcgcggtcgaatgggagtcgaatggacagccggagaacaactacaagacaacacctccagtgctgaaatcggatgggagcttctttctgtattcgaagctcacggtagataagtcgaggtggcaacaaggaaatgtgttttcatgttcggtgatgcatgaagcgctccataaccactatacgcagaaatcgctttcgctctccggtgaatgc

SEQ ID NO: 221 - protein, 497 aa, Artificial Sequence
  Description of Artificial Sequence: Synthetic polypeptide
EPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 222 - DNA, 651 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggta

SEQ ID NO: 223 - protein, 217 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 224 - DNA, 2913 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataagacccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaaggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 225 - protein, 971 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 226 - DNA, 2913 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgacaagacccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaaggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 227 - protein, 971 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 228 - DNA, 2913 bp, Artificial Sequence; identical to SEQ ID NO: 226
  Description of Artificial Sequence: Synthetic polynucleotide

SEQ ID NO: 229 - protein, 971 aa, Artificial Sequence; identical to SEQ ID NO: 227
  Description of Artificial Sequence: Synthetic polypeptide

SEQ ID NO: 230 - DNA, 660 bp, Artificial Sequence
  Description of Artificial Sequence: Synthetic polynucleotide
gacattcagatgacacagtcgccgtcgtcgcttagcgcgtcagtgggagatagggtgacgattacgtgcaagtcatcccagtcgctgttgtatacatcgagccagaagaactacctcgcgtggtaccaacagaagccggggaaagcgcccaaactcctgatctattgggcctcgaccagagagtccggagtaccatcgcgcttctcaggcagcgggagcgggacggacttcacactgacgatctcctccttgcaacccgaagattttgctacgtattactgtcaacaatactatgcctacccctggacctttggccagggtactaaggtcgagatcaaacgtacggtggccgctccctccgtctttatctttcctccaagcgacgagcagctgaagtctggcaccgcaagtgtggtgtgtctgctgaacaatttctaccccagggaagccaaagtgcaatggaaagtggataacgctctgcagtcaggaaattcccaggagagcgtcacagaacaagactctaaagatagtacttattcactgtccagcaccctgacactgtctaaggccgattatgagaaacacaaggtgtatgcctgtgaagtcactcatcaggggctgagttcacctgtgaccaaatcctttaacagaggtgagtgc

SEQ ID NO: 231 - protein, 220 aa, Artificial Sequence
  Description of Artificial Sequence: Synthetic polypeptide
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 750 bp, Artificial Sequence
  Description of Artificial Sequence: Synthetic polynucleotide
caagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 233 - protein, 250 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 234 - DNA, 2922 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 235 - protein, 974 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 236 - DNA, 771 bp, Artificial Sequence
  Description of Artificial Sequence: Synthetic polynucleotide
gaggtgcaactggtccagtcaggggcggaggtcaagaagcccggaagctccgtaaaggtatcatgcaaggcctcgggtggaaccttctcctcgtacgccatcggttgggtgagacaagctcccgggcagggcctcgaatggatgggcggaatcattcccatctttggaatcgcgaactatgcgcagaaatttcagggtagagtaacgattacagcggatgaatcgacttcgtccgcatacatggagctttcgtcacttcggtcagaggacactgccgtgtattactgtgcgcgggaggaaggcccgtattgtagctcgacctcgtgctacgctgcctttgacatttgggggcagggaacacttgtcacagtatcgagcgcgtccacgggcggagggggaagcggaggtgggggatcgggagggggaggatcagggggagggggctcccagagcgtgttgacccaagatccagctgtgtccgtcgcactgggacagacggtcaaaatcacgtgccagggtgactcgcttcgctcgtacttcgcgtcatggtatcagcaaaaacctggtcaggcaccgacgttggtgatgtacgcaaggaatgatcgacctgccggggtcccggacaggttctcggggagcaagagcgggacatccgcgtcgttggcgatctccggcctccagcccgaagatgaggccgattactattgtgcagcgtgggacgactcactgaacgggtatctcttcggggcaggcactaaactcacggtgttg

SEQ ID NO: 237 - protein, 257 aa, Artificial Sequence
  Description of Artificial Sequence: Synthetic polypeptide
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 238 - DNA, 2943 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatccgaggtgcaactggtccagtcaggggcggaggtcaagaagcccggaagctccgtaaaggtatcatgcaaggcctcgggtggaaccttctcctcgtacgccatcggttgggtgagacaagctcccgggcagggcctcgaatggatgggcggaatcattcccatctttggaatcgcgaactatgcgcagaaatttcagggtagagtaacgattacagcggatgaatcgacttcgtccgcatacatggagctttcgtcacttcggtcagaggacactgccgtgtattactgtgcgcgggaggaaggcccgtattgtagctcgacctcgtgctacgctgcctttgacatttgggggcagggaacacttgtcacagtatcgagcgcgtccacgggcggagggggaagcggaggtgggggatcgggagggggaggatcagggggagggggctcccagagcgtgttgacccaagatccagctgtgtccgtcgcactgggacagacggtcaaaatcacgtgccagggtgactcgcttcgctcgtacttcgcgtcatggtatcagcaaaaacctggtcaggcaccgacgttggtgatgtacgcaaggaatgatcgacctgccggggtcccggacaggttctcggggagcaagagcgggacatccgcgtcgttggcgatctccggcctccagcccgaagatgaggccgattactattgtgcagcgtgggacgactcactgaacgggtatctcttcggggcaggcactaaactcacggtgttg

SEQ ID NO: 239 - protein, 981 aa, Artificial Sequence [sequence omitted]

SEQ ID NO: 240 - DNA, 57 bp, Artificial Sequence
  Description of Artificial Sequence: Synthetic oligonucleotide
atgggcttcggactgtcgtggctttttctggtggcgattcttaagggggtccagtgc

SEQ ID NO: 241 - protein, 19 aa, Artificial Sequence
  Description of Artificial Sequence: Synthetic peptide
MGFGLSWLFLVAILKGVQC

SEQ ID NO: 242 - DNA, 60 bp, Artificial Sequence
  Description of Artificial Sequence: Synthetic oligonucleotide
atgggcacccccgcacagctcttgttcttgctgcttctttggctccctgacacaactggt

SEQ ID NO: 243 - protein, 20 aa, Artificial Sequence
  Description of Artificial Sequence: Synthetic peptide
MGTPAQLLFLLLLWLPDTTG

SEQ ID NO: 244 - DNA, 708 bp, Artificial Sequence
  Description of Artificial Sequence: Synthetic polynucleotide
atgggctttggactttcgtggctttttctcgtagcgattttgaagggcgtgcagtgcgaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggta

SEQ ID NO: 245 - protein, 236 aa, Artificial Sequence
  Description of Artificial Sequence: Synthetic polypeptide
MGFGLSWLFLVAILKGVQCEVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 246 - DNA, 720 bp, Artificial Sequence
  Description of Artificial Sequence: Synthetic polynucleotide
atgggcacccccgcacagctcttgttcttgctgcttctttggctccctgacacaactggtgacattcagatgacacagtcgccgtcgtcgcttagcgcgtcagtgggagatagggtgacgattacgtgcaagtcatcccagtcgctgttgtatacatcgagccagaagaactacctcgcgtggtaccaacagaagccggggaaagcgcccaaactcctgatctattgggcctcgaccagagagtccggagtaccatcgcgcttctcaggcagcgggagcgggacggacttcacactgacgatctcctccttgcaacccgaagattttgctacgtattactgtcaacaatactatgcctacccctggacctttggccagggtactaaggtcgagatcaaacgtacggtggccgctccctccgtctttatctttcctccaagcgacgagcagctgaagtctggcaccgcaagtgtggtgtgtctgctgaacaatttctaccccagggaagccaaagtgcaatggaaagtggataacgctctgcagtcaggaaattcccaggagagcgtcacagaacaagactctaaagatagtacttattcactgtccagcaccctgacactgtctaaggccgattatgagaaacacaaggtgtatgcctgtgaagtcactcatcaggggctgagttcacctgtgaccaaatcctttaacagaggtgagtgc

SEQ ID NO: 247 - protein, 240 aa, Artificial Sequence
  Description of Artificial Sequence: Synthetic polypeptide
MGTPAQLLFLLLLWLPDTTGDIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 12 aa, Artificial Sequence
  Description of Artificial Sequence: Synthetic peptide
PRDCGCKPCICT

SEQ ID NO: 249 - protein, 12 aa, Artificial Sequence
  Description of Artificial Sequence: Synthetic peptide
PKSCGCKPCICT

SEQ ID NO: 250 - protein, 12 aa, Artificial Sequence
  Description of Artificial Sequence: Synthetic peptide
PKSCGCKPCICP

SEQ ID NO: 251 - protein, 13 aa, Artificial Sequence
  Description of Artificial Sequence: Synthetic peptide
PRDCGCKPCPPCP

SEQ ID NO: 252 - protein, 13 aa, Artificial Sequence
  Description of Artificial Sequence: Synthetic peptide
PRDCGCHTCPPCP

SEQ ID NO: 253 - protein, 12 aa, Artificial Sequence
  Description of Artificial Sequence: Synthetic peptide
PKSCDCHCPPCP

SEQ ID NO: 254 - protein, 11 aa, Artificial Sequence
  Description of Artificial Sequence: Synthetic peptide
RKCCVECPPCP

SEQ ID NO: 255 - DNA, 705 bp, Artificial Sequence
  Description of Artificial Sequence: Synthetic polynucleotide
atgggattcggactctcctggttgtttttggtggcaattctcaagggcgtccaatgtcaggtacaacttgtgcagtcaggagcggaggtgaagaagcctggtgcatcggtcaaagtgtcatgcaaagcctcggggtacatctttactgcgtacacaatgcactgggtcagacaggctccgggacaaggtctggaatggatggggtggatcaagcccaataacgggctcgcgaattacgcccagaaattccaggggagagtgactatgacaagggatacgagcatttcgacggcgtatatggagctctcgcgcctgcggtcagatgacacagccgtatactattgcgcgcgatcggaaatcaccaccgaattcgactattggggtcagggaactcttgtcacggtatccagcgctagcaccaagggcccgtcagtattcccgcttgcaccctcgtcgaaatcaacatcgggcggaacagcagcccttggctgcttggtaaaagactacttcccagagccagtaacggtatcgtggaattccggagctcttacgtcgggggtccatacatttcccgcggtactccaatcgtcgggactgtactcattgtcgtcagtcgtgaccgtgccatccagctccttgggaacccagacttacatctgcaacgtcaaccacaagccctcgaacactaaagtggacaagaaagtg

SEQ ID NO: 256 - protein, 235 aa, Artificial Sequence
  Description of Artificial Sequence: Synthetic polypeptide
MGFGLSWLFLVAILKGVQCQVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 257 - DNA, 753 bp, Artificial Sequence
  Description of Artificial Sequence: Synthetic polynucleotide
caggtgcagctggtggagagcggcggcggcgtggtgcagcccggcgagagcctgagactgagctgcgccgtgagcggcttcagcctgaccaactacggcgtgcactgggtgagacaggcccccggcaagggcctggagtgggtgggcgtgatctggagcggcggcaacaccgactacaacacccccttcaccagcagattcaccatcagcaaggacaacagcaagaacaccgtgtacctgcagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccgacttccagagcgtgacccccggcgagaaggtgaccatcacctgcagagccagccagagcatcggcaccaacatccactggtaccagcagaagcccgaccagagccccaagctgctgatcaagtacgccagcgagagcatcagcggcgtgcccagcagattcagcggcagcggcagcggcaccgacttcaccctgaccatcaacagcctggaggccgaggacgaggccacctactactgccagcagaacaacaactggcccaccaccttcggccagggcaccaaggtggagatcaagagaacc

SEQ ID NO: 258 - protein, 251 aa, Artificial Sequence
  Description of Artificial Sequence: Synthetic polypeptide
QVQLVESGGGVVQPGESLRLSCAVSGFSLTNYGVHWVRQAPGKGLEWVGVIWSGGNTDYNTPFTSRFTISKDNSKNTVYLQMNSLRAEDTAVYYCARALTYYDYEFAYWGQGTLVTVSSASTGGGGSGGGGSGGGGSGGGGSDIVLTQSPDFQSVTPGEKVTITCRASQSIGTNIHWYQQKPDQSPKLLIKYASESISGVPSRFSGSGSGTDFTLTINSLEAEDEATYYCQQNNNWPTTFGQGTKVEIKRT

SEQ ID NO: 259 - DNA, 2925 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaggtgcagctggtggagagcggcggcggcgtggtgcagcccggcgagagcctgagactgagctgcgccgtgagcggcttcagcctgaccaactacggcgtgcactgggtgagacaggcccccggcaagggcctggagtgggtgggcgtgatctggagcggcggcaacaccgactacaacacccccttcaccagcagattcaccatcagcaaggacaacagcaagaacaccgtgtacctgcagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccgacttccagagcgtgacccccggcgagaaggtgaccatcacctgcagagccagccagagcatcggcaccaacatccactggtaccagcagaagcccgaccagagccccaagctgctgatcaagtacgccagcgagagcatcagcggcgtgcccagcagattcagcggcagcggcagcggcaccgacttcaccctgaccatcaacagcctggaggccgaggacgaggccacctactactgccagcagaacaacaactggcccaccaccttcggccagggcaccaaggtggagatcaagagaacc

SEQ ID NO: 260 - protein, 975 aa, Artificial Sequence [sequence omitted]

SEQ ID NO: 261 - protein, 104 aa, Homo sapiens
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 262 - protein, 104 aa, Homo sapiens
GPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 263 - protein, 15 aa, Artificial Sequence
  Description of Artificial Sequence: Synthetic peptide
PPPPCDKTHTCPPCP

SEQ ID NO: 264 - protein, 13 aa, Artificial Sequence
  Description of Artificial Sequence: Synthetic peptide
EPKSCPPPCPPCP

SEQ ID NO: 265 - protein, 14 aa, Artificial Sequence
  Description of Artificial Sequence: Synthetic peptide
EPKSCPPCPCPPCP

SEQ ID NO: 266 - protein, 13 aa, Mus sp.
VPRDCGCKPCICT

SEQ ID NO: 267 - protein, 14 aa, Artificial Sequence
  Description of Artificial Sequence: Synthetic peptide
VPRDCTIKPCPPCP

SEQ ID NO: 268 - protein, 12 aa, Artificial Sequence
  Description of Artificial Sequence: Synthetic peptide
ERKPCVECPPCP

SEQ ID NO: 269 - protein, 12 aa, Artificial Sequence
  Description of Artificial Sequence: Synthetic peptide
ERKCPVECPPCP

SEQ ID NO: 270 - protein, 6 aa, Homo sapiens
VPPPPP

SEQ ID NO: 271 - protein, 15 aa, Artificial Sequence
  Description of Artificial Sequence: Synthetic peptide
EPKSCPCPPPPPCCP

SEQ ID NO: 272 - protein, 14 aa, Artificial Sequence
  Description of Artificial Sequence: Synthetic peptide
EPKSCPCPPPPCCP

SEQ ID NO: 273 - protein, 15 aa, Artificial Sequence
  Description of Artificial Sequence: Synthetic peptide
EPKSCPVPPPPPCCP

SEQ ID NO: 274 - DNA, 753 bp, Artificial Sequence
  Description of Artificial Sequence: Synthetic polynucleotide
caggtgcagctggtggagagcggcggcggcgtggtgcagcccggcgagagcctgagactgagctgcgccgtgagcggcttcagcctgaccaactacggcgtgcactgggtgagacaggcccccggcaagggcctggagtgggtgggcgtgatctggagcggcggcaacaccgactacaacacccccttcaccagcagattcaccatcagcaaggacaacagcaagaacaccgtgtacctgcagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccagcagcctgagcgtgacccccggcgagaaggtgaccttcacctgcagagccagccagagcatcggcaccaacatccactggtaccagcagaagcccggccagagccccaagctgctgatcaagtacgccagcgagagcatcagcggcgtgcccagcagattcagcggcagcggcagcggcaccgacttcaccctgaccatcaacagcgtggaggccgaggacgaggccacctactactgccagcagaacaacaactggcccaccaccttcggccagggcaccaagctggagatcaagagaacc

SEQ ID NO: 275 - protein, 251 aa, Artificial Sequence
  Description of Artificial Sequence: Synthetic polypeptide
QVQLVESGGGVVQPGESLRLSCAVSGFSLTNYGVHWVRQAPGKGLEWVGVIWSGGNTDYNTPFTSRFTISKDNSKNTVYLQMNSLRAEDTAVYYCARALTYYDYEFAYWGQGTLVTVSSASTGGGGSGGGGSGGGGSGGGGSDIVLTQSPSSLSVTPGEKVTFTCRASQSIGTNIHWYQQKPGQSPKLLIKYASESISGVPSRFSGSGSGTDFTLTINSVEAEDEATYYCQQNNNWPTTFGQGTKLEIKRT

SEQ ID NO: 276 - DNA, 753 bp, Artificial Sequence
  Description of Artificial Sequence: Synthetic polynucleotide
caggtgcagctggtggagagcggcggcggcgtggtgcagcccggcgagagcctgagaatcagctgcgccgtgagcggcttcagcctgaccaactacggcgtgcactgggtgagacaggcccccggcaagggcctggagtggctgggcgtgatctggagcggcggcaacaccgactacaacacccccttcaccagcagactgaccatcagcaaggacaacagcaagagcaccgtgtacttccagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccgacttccagagcgtgacccccggcgagaaggtgaccatcacctgcagagccagccagagcatcggcaccaacatccactggtaccagcagaagcccgaccagagccccaagctgctgatcaagtacgccagcgagagcatcagcggcgtgcccagcagattcagcggcagcggcagcggcaccgacttcaccctgaccatcaacagcctggaggccgaggacgaggccacctactactgccagcagaacaacaactggcccaccaccttcggccagggcaccaaggtggagatcaagagaacc

SEQ ID NO: 277 - protein, 251 aa, Artificial Sequence
  Description of Artificial Sequence: Synthetic polypeptide
QVQLVESGGGVVQPGESLRISCAVSGFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGSGGGGSGGGGSDIVLTQSPDFQSVTPGEKVTITCRASQSIGTNIHWYQQKPDQSPKLLIKYASESISGVPSRFSGSGSGTDFTLTINSLEAEDEATYYCQQNNNWPTTFGQGTKVEIKRT

SEQ ID NO: 278 - DNA, 753 bp, Artificial Sequence
  Description of Artificial Sequence: Synthetic polynucleotide
caggtgcagctggtggagagcggcggcggcgtggtgcagcccggcgagagcctgagaatcagctgcgccgtgagcggcttcagcctgaccaactacggcgtgcactgggtgagacaggcccccggcaagggcctggagtggctgggcgtgatctggagcggcggcaacaccgactacaacacccccttcaccagcagactgaccatcagcaaggacaacagcaagagcaccgtgtacttccagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccagcagcctgagcgtgacccccggcgagaaggtgaccttcacctgcagagccagccagagcatcggcaccaacatccactggtaccagcagaagcccggccagagccccaagctgctgatcaagtacgccagcgagagcatcagcggcgtgcccagcagattcagcggcagcggcagcggcaccgacttcaccctgaccatcaacagcgtggaggccgaggacgaggccacctactactgccagcagaacaacaactggcccaccaccttcggccagggcaccaagctggagatcaagagaacc

SEQ ID NO: 279 - protein, 251 aa, Artificial Sequence
  Description of Artificial Sequence: Synthetic polypeptide
QVQLVESGGGVVQPGESLRISCAVSGFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGSGGGGSGGGGSDIVLTQSPSSLSVTPGEKVTFTCRASQSIGTNIHWYQQKPGQSPKLLIKYASESISGVPSRFSGSGSGTDFTLTINSVEAEDEATYYCQQNNNWPTTFGQGTKLEIKRT

SEQ ID NO: 280 - DNA, 2925 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaggtgcagctggtggagagcggcggcggcgtggtgcagcccggcgagagcctgagactgagctgcgccgtgagcggcttcagcctgaccaactacggcgtgcactgggtgagacaggcccccggcaagggcctggagtgggtgggcgtgatctggagcggcggcaacaccgactacaacacccccttcaccagcagattcaccatcagcaaggacaacagcaagaacaccgtgtacctgcagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccagcagcctgagcgtgacccccggcgagaaggtgaccttcacctgcagagccagccagagcatcggcaccaacatccactggtaccagcagaagcccggccagagccccaagctgctgatcaagtacgccagcgagagcatcagcggcgtgcccagcagattcagcggcagcggcagcggcaccgacttcaccctgaccatcaacagcgtggaggccgaggacgaggccacctactactgccagcagaacaacaactggcccaccaccttcggccagggcaccaagctggagatcaagagaacc

SEQ ID NO: 281 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRLSCAVSGFSLTNYGVHWVRQAPGKGLEWVGVIWSGGNTDYNTPFTSRFTISKDNSKNTVYLQMNSLRAEDTAVYYCARALTYYDYEFAYWGQGTLVTVSSASTGGGGSGGGGSGGGGSGGGGSDIVLTQSPSSLSVTPGEKVTFTCRASQSIGTNIHWYQQKPGQSPKLLIKYASESISGVPSRFSGSGSGTDFTLTINSVEAEDEATYYCQQNNNWPTTFGQGTKLEIKRT

SEQ ID NO: 282 - DNA, 2925 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaggtgcagctggtggagagcggcggcggcgtggtgcagcccggcgagagcctgagaatcagctgcgccgtgagcggcttcagcctgaccaactacggcgtgcactgggtgagacaggcccccggcaagggcctggagtggctgggcgtgatctggagcggcggcaacaccgactacaacacccccttcaccagcagactgaccatcagcaaggacaacagcaagagcaccgtgtacttccagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccgacttccagagcgtgacccccggcgagaaggtgaccatcacctgcagagccagccagagcatcggcaccaacatccactggtaccagcagaagcccgaccagagccccaagctgctgatcaagtacgccagcgagagcatcagcggcgtgcccagcagattcagcggcagcggcagcggcaccgacttcaccctgaccatcaacagcctggaggccgaggacgaggccacctactactgccagcagaacaacaactggcccaccaccttcggccagggcaccaaggtggagatcaagagaacc

SEQ ID NO: 283 - protein, 975 aa, Artificial Sequence [sequence omitted]

SEQ ID NO: 284 - DNA, 2925 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaggtgcagctggtggagagcggcggcggcgtggtgcagcccggcgagagcctgagaatcagctgcgccgtgagcggcttcagcctgaccaactacggcgtgcactgggtgagacaggcccccggcaagggcctggagtggctgggcgtgatctggagcggcggcaacaccgactacaacacccccttcaccagcagactgaccatcagcaaggacaacagcaagagcaccgtgtacttccagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccagcagcctgagcgtgacccccggcgagaaggtgaccttcacctgcagagccagccagagcatcggcaccaacatccactggtaccagcagaagcccggccagagccccaagctgctgatcaagtacgccagcgagagcatcagcggcgtgcccagcagattcagcggcagcggcagcggcaccgacttcaccctgaccatcaacagcgtggaggccgaggacgaggccacctactactgccagcagaacaacaactggcccaccaccttcggccagggcaccaagctggagatcaagagaacc

SEQ ID NO: 285 - protein, 975 aa, Artificial Sequence [sequence omitted]

SEQ ID NO: 286 - DNA, 648 bp, Artificial Sequence
  Description of Artificial Sequence: Synthetic polynucleotide
caggtacaacttgtgcagtcaggagcggaggtgaagaagcctggtgcatcggtcaaagtgtcatgcaaagcctcggggtacatctttactgcgtacacaatgcactgggtcagacaggctccgggacaaggtctggaatggatggggtggatcaagcccaataacgggctcgcgaattacgcccagaaattccaggggagagtgactatgacaagggatacgagcatttcgacggcgtatatggagctctcgcgcctgcggtcagatgacacagccgtatactattgcgcgcgatcggaaatcaccaccgaattcgactattggggtcagggaactcttgtcacggtatccagcgctagcaccaagggcccgtcagtattcccgcttgcaccctcgtcgaaatcaacatcgggcggaacagcagcccttggctgcttggtaaaagactacttcccagagccagtaacggtatcgtggaattccggagctcttacgtcgggggtccatacatttcccgcggtactccaatcgtcgggactgtactcattgtcgtcagtcgtgaccgtgccatccagctccttgggaacccagacttacatctgcaacgtcaaccacaagccctcgaacactaaagtggacaagaaagtg

SEQ ID NO: 287 - protein, 216 aa, Artificial Sequence
  Description of Artificial Sequence: Synthetic polypeptide
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 288 - DNA, 654 bp, Artificial Sequence
  Description of Artificial Sequence: Synthetic polynucleotide
gacatcgtgctgacccagtcaccggattcgcttgcagtctcactgggagagagagccacgatcaattgcaagtcctcggaatcagtggacagctacgctaactcattcatgcactggtatcagcagaagcctggccagccgcccaagttgctgatctaccgcgcaagcacacgggagtcgggggtgccagataggttttccggatcgggttcccgaacggacttcacactcacgatttcatccttgcaagccgaagatgtggcggtctattactgtcaacagtcgaaagaggatccccttacttttggtgggggtactaaagtagagattaagcgtacggtggcagcgccgtcagtctttatcttccctccttcggatgagcagcttaagagcgggacagcctcagtagtctgccttctcaacaacttttacccgagagaggccaaggtgcagtggaaggtggataatgccttgcagtcagggaactcacaagaatcggtcacagaacaggactccaaagatagcacttattccctgtcaagcacgctcactttgtccaaagcggactacgagaagcacaaagtgtacgcttgcgaggtgactcatcaaggattgtcgagccccgtaacgaagagcttcaatcggggcgagtgt

SEQ ID NO: 289 - protein, 218 aa, Artificial Sequence
  Description of Artificial Sequence: Synthetic polypeptide
DIVLTQSPDSLAVSLGERATINCKSSESVDSYANSFMHWYQQKPGQPPKLLIYRASTRESGVPDRFSGSGSRTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - DNA, 2922 bp, Artificial Sequence
  Description of Artificial Sequence: Synthetic polynucleotide
caggtacaacttgtgcagtcaggagcggaggtgaagaagcctggtgcatcggtcaaagtgtcatgcaaagcctcggggtacatctttactgcgtacacaatgcactgggtcagacaggctccgggacaaggtctggaatggatggggtggatcaagcccaataacgggctcgcgaattacgcccagaaattccaggggagagtgactatgacaagggatacgagcatttcgacggcgtatatggagctctcgcgcctgcggtcagatgacacagccgtatactattgcgcgcgatcggaaatcaccaccgaattcgactattggggtcagggaactcttgtcacggtatccagcgctagcaccaagggcccgtcagtattcccgcttgcaccctcgtcgaaatcaacatcgggcggaacagcagcccttggctgcttggtaaaagactacttcccagagccagtaacggtatcgtggaattccggagctcttacgtcgggggtccatacatttcccgcggtactccaatcgtcgggactgtactcattgtcgtcagtcgtgaccgtgccatccagctccttgggaacccagacttacatctgcaacgtcaaccacaagccctcgaacactaaagtggacaagaaagtggaaccgaaatcatgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgcggaggtggagggagcggtggtgggggatcccaggtgcagctggtggagagcggcggcggcgtggtgcagcccggcgagagcctgagactgagctgcgccgtgagcggcttcagcctgaccaactacggcgtgcactgggtgagacaggcccccggcaagggcctggagtgggtgggcgtgatctggagcggcggcaacaccgactacaacacccccttcaccagcagattcaccatcagcaaggacaacagcaagaacaccgtgtacctgcagatgaacagcctgagagccgaggacaccgccgtgtactactgcgccagagccctgacctactacgactacgagttcgcctactggggccagggcaccctggtgaccgtgagcagcgccagcaccggcggcggcggcagcggcggcggcggcagcggcggcggcggcagcggcggcggcggcagcgacatcgtgctgacccagagccccgacttccagagcgtgacccccggcgagaaggtgaccatcacctgcagagccagccagagcatcggcaccaacatccactggtaccagcagaagcccgaccagagccccaagctgctgatcaagtacgccagcgagagcatcagcggcgtgcccagcagattcagcggcagcggcagcggcaccgacttcaccctgaccatcaacagcctggaggccgaggacgaggccacctactactgccagcagaacaacaactggcccaccaccttcggccagggcaccaaggtggagatcaagagaacc

SEQ ID NO: 291 - protein, 974 aa, Artificial Sequence
  Description of Artificial Sequence: Synthetic polypeptide
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRLSCAVSGFSLTNYGVHWVRQAPGKGLEWVGVIWSGGNTDYNTPFTSRFTISKDNSKNTVYLQMNSLRAEDTAVYYCARALTYYDYEFAYWGQGTLVTVSSASTGGGGSGGGGSGGGGSGGGGSDIVLTQSPDFQSVTPGEKVTITCRASQSIGTNIHWYQQKPDQSPKLLIKYASESISGVPSRFSGSGSGTDFTLTINSLEAEDEATYYCQQNNNWPTTFGQGTKVEIKRT

SEQ ID NO: 292 - DNA, 1530 bp, Artificial Sequence
  Description of Artificial Sequence: Synthetic polynucleotide
atgggcttcggactgtcgtggctttttctggtggcgattcttaagggggtccagtgcgataagacccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaatgataa

SEQ ID NO: 293 - protein, 508 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - DNA, 1530 bp, Artificial Sequence
  Description of Artificial Sequence: Synthetic polynucleotide
atgggcttcggactgtcgtggctttttctggtggcgattcttaagggggtccagtgcgataaaactcacacgtgccctccatgccctgctccggaacttctcgggggaccgtccgtattcctctttcctcctaagcctaaggacaccctcatgatcagcaggacccccgaggtgacgtgtgtagtcgtggatgtgtcccacgaggacccggaagtcaagttcaactggtatgtagatggagtggaggtccataatgccaagaccaagccaagagaggagcagtatcagtcgacttatcgggtggtcagcgtcctcacggtacttcatcaggattggctgaatggaaaggagtacaaatgtaaggtatccaacaaagcgttgccagcgcccatcgaaaagacaatctcgaaggcgaagggacaaccccgggaaccgcaagtgtgtaccctgccaccttcccgggaggagatgacgaaaaaccaggtatccctgtcgtgcgccgtgaaagggttttacccatcggatatcgcagtggagtgggaaagcaatgggcagccggaaaacaactataagaccacgccccctgtactcgactcggatgggtcctttttcctcgtcagcaaacttacggtagacaaaagcaggtggcaacaggggaatgtgttcagctgctcagtcatgcacgaggcactccataaccattacactcagaaatcactgtcgctgtcgcccggtaaagggggaggtgggtcgggcggtgggggaagcggtggtgggggatcaggtgggggaggttcgggaggtggtgggagcggtggaggcggttccggaggaggcgggtcgggtggaggtggatcgtgcccaccgtgccccgcaccggaactccttgggggaccatccgtgtttctgtttccaccgaagccaaaggacactctcatgatctcgcgcacaccagaggtgacatgtgtcgtcgtcgatgtgtcacacgaagatccagaggtcaagtttaactggtacgtggacggagtcgaggtccacaatgcgaaaacgaaacccagagaagagcagtaccagtcaacataccgggtggtgagcgtattgaccgtgcttcaccaggactggcttaacgggaaagagtacaagtgtaaggtcagcaataaggcgctcccagcgcctattgagaaaactatctcgaaagcaaaggggcagccacgagagccccaagtgtgtacgctgccaccctgtcgggaggaaatgaccaagaatcaagtctcgctttggtgccttgtgaagggattctatcccagcgacattgctgtagagtgggagtcgaacgggcaacccgagaataactacaagactactccgccggtgttggactcggacgggtcgttcttcctttatagcaaactcacagtcgacaagtccagatggcagcagggaaatgtcttttcctgctcggtaatgcacgaagcgttgcataaccactatacacagaagtcgctttcgttgtcacccgggaaatgataa

SEQ ID NO: 295 - protein, 508 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVCTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - DNA, 1530 bp, Artificial Sequence
  Description of Artificial Sequence: Synthetic polynucleotide
atgggcttcggactgtcgtggctttttctggtggcgattcttaagggggtccagtgcgacaaaacgcacacttgtccgccgtgccctgccccagagttgcttggaggaccatcagtatttctcttccctcctaagccgaaagacacactcatgatctcacgcacaccggaagtaacttgcgtggtggtggatgtgtcgcatgaagatcccgaggtcaaattcaactggtacgtcgacggtgtggaggtgcacaacgccaagacgaaacccagagaagagcagtatcagtcgacctaccgagtggtatccgtgcttacggtgctgcatcaggattggttgaatggaaaagaatacaaatgcaaagtctcgaataaggcgctcccagccccaatcgaaaagacgatttccaaggcgaaggggcagcctcgggaacctcaggtctatacccttcctccgtcacgcgaggaaatgacaaagaatcaggtcagcctcacatgcctcgtgaagggattctatccgtcggatattgctgtcgagtgggaatcgaacggacagcccgagaacaattacaaaacaactcctcccgtacttgactcggacgggagctttttccttacgtcaaagctgaccgtcgataaaagcaggtggcagcaagggaatgtgttttcgtgctcggtcatgcacgaagcacttcataaccactacacccagaaatccttgagcctgtcaccggggaagggaggagggggtagcggcggtggagggagcggaggaggcgggtccggtgggggtgggtccgggggtggcggaagcggtggcggaggttcgggagggggaggaagcggagggggtggatcgtgtcctccgtgcccagcccccgaactcctcgggggaccctcggtattcctttttccgccgaaacccaaggacactttgatgattagccggacgcccgaggtgacatgcgtggtcgtggatgtatcgcatgaggaccccgaagtgaagttcaattggtacgtggatggggtggaagtccataacgcaaagaccaagcccagagaggagcagtaccaatcgacgtatagggtcgtgtccgtcctcacagtcttgcaccaggactggttgaacgggaaggagtataagtgtaaggtcagcaacaaagcgttgcctgcgcccattgaaaagactatctcaaaagcaaagggacagcccagggagccccaagtgtacacactgcccccgtcaagagaagaaatgaccaaaaatcaagtgtccctctactgcttggtgaaggggttctatcccagcgacatcgcggtagagtgggagtcaaatggccagcccgaaaacaactacaaaacgacaccgcccgtgttggattcggatgggtcattctttctgtattcaaaactgacagtggacaagtcgcggtggcaacaggggaacgtgttttcctgttccgtaatgcacgaggcgttgcacaatcactatacgcagaagtccctctcgctttcacccgggaagtgataa

SEQ ID NO: 297 - protein, 508 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - DNA, 1530 bp, Artificial Sequence
  Description of Artificial Sequence: Synthetic polynucleotide
atgggcttcggactgtcgtggctttttctggtggcgattcttaagggggtccagtgcgataagacttgctgctgtcctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaatcaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaatgataa

SEQ ID NO: 299 - protein, 508 aa, Artificial Sequence
  Description of Artificial Sequence: Synthetic polypeptide
MGFGLSWLFLVAILKGVQCDKTCCCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - DNA, 1530 bp, Artificial Sequence
  Description of Artificial Sequence: Synthetic polynucleotide
atgggcttcggactgtcgtggctttttctggtggcgattcttaagggggtccagtgcgataagtgccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagggtgggggtggctcagggggtgggggatcaggtggtggtggtagcggaggtggagggagcggaggcggaggctccggtggaggaggttccggaggtggcgggtcagggggaggagggtcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaatgataa

SEQ ID NO: 301 - protein, 508 aa, Artificial Sequence
  Description of Artificial Sequence: Synthetic polypeptide
MGFGLSWLFLVAILKGVQCDKCHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - DNA, 1539 bp, Artificial Sequence
  Description of Artificial Sequence: Synthetic polynucleotide
atgggcttcggactgtcgtggctttttctggtggcgattcttaagggggtccagtgcgataaaacacacacatgcccaccatgcccagcgcctgaacttttgggaggtccctcggtgtttttgtttcctcctaagcctaaggacaccctgatgatctcccgcactccggaagtgacgtgtgtcgtagtcgacgtcagccatgaggaccctgaggtgaaattcaactggtacgtagatggtgtggaggtgcataatgcaaaaactaagcctcgggaggaacaatatcaaagcacataccgggtcgtgtccgtgctcacggtacttcatcaggattggctcaacgggaaagaatacaaatgtaaggtgtccaacaaggctctcccggcaccgattgagaaaacgatcagcaaggccaaggggcagccccgagaaccccaagtatacacacttcccccgtccagggaggagatgaccaagaaccaggtgtcgctgtcgtgtgcggtcaaggggttttatcccagcgacatcgcggtagagtgggagtcgaacggccagcccgagaacaactacaagacaacaccgcctgtattggactcggacgggtcgtttttcctggtcagcaagctcacagtggataaaagccgctggcagcaggggaatgtattctcctgctccgtcatgcacgaggcgcttcacaaccattacacgcaaaaatccctgtccttgtccaagtcatgcgacaagacgggaggaggagggtcaggcggaggaggaagcgggggtggagggtccggtggtggtgggagcggaggtggagggagcggtggaggtggtagcgggggaggtggatcgggagggggtgggagctgtccgccatgtccagccccggaacttctcgggggaccgtcagtctttctttttccgccgaagcccaaggacaccttgatgattagccgcacgccggaggtcacgtgcgtagtagtggatgtatcccacgaggaccccgaggtcaaattcaattggtatgtcgacggagtggaagtacacaacgcaaagacaaagccgagagaagagcagtaccaatccacttatagggtagtctcggtcttgacagtactgcaccaggactggcttaatggaaaggaatacaagtgcaaagtctcaaacaaagccctccccgcacccatcgaaaagacaatctcgaaagcgaaaggacagcccagagagcctcaagtgtataccctgcccccgtcaagagaagagatgacgaagaaccaagtgtccctctggtgtctcgtgaaaggtttttaccccagcgatattgccgtcgaatgggaaagcaatggtcagcccgaaaacaattacaagactacgcctcccgtattggattcggatggttcgttcttcttgtactcaaagcttactgtcgataagtcgcggtggcagcaaggcaatgtgtttagctgttcggtaatgcatgaggcgctccacaatcactatacacagaagagcttgtccctcagcggggagtgctgataa

SEQ ID NO: 303 - protein, 511 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 304 - DNA, 1470 bp, Artificial Sequence
  Description of Artificial Sequence: Synthetic polynucleotide
atgggcttcggactgtcgtggctttttctggtggcgattcttaagggggtccagtgcgacaagacccacacctgcccaccgtgtccagcgcccgagctcctcggagggccgtcggtgttcctctttcccccaaagcctaaagacactctgatgatcagccgcactccagaagtgacatgtgtggtggtggatgtctcgcatgaggacccggaagtcaaattcaattggtacgtggatggtgtcgaagtgcacaacgccaagacaaaaccgcgcgaggagcagtaccagagcacctaccgggtggtatcagtgcttacagtactgcatcaggattggctgaacggaaaggagtacaagtgtaaagtcagcaacaaagcgctcccggctccgatcgagaaaacgatctcaaaggccaagggccagccgcgagaaccccaagtatacacgttgcccccttcaagggaggaaatgaccaagaatcaggtgtcactgagctgcgccgtcaagggattctacccctcggacattgcagtagagtgggagtcgaatgggcaacccgaaaacaactataagacgacacccccggtcctcgactcagatggatcgttcttccttgtatcaaaattgacggtcgacaagagccggtggcagcaaggtaacgtattttcgtgttcggtgatgcatgaagcgctgcataaccactatacgcagaagagcttgtccttgtcaccaggcaagggaggtgggggttcgggcggaggaggtagcggcggagggggtagcggaggtggcgggtcctgtcccccgtgccccgcaccggagctgctgggaggtccgtcagtgtttttgtttcctcccaagccgaaagacacgctgatgatctcgaggacgcccgaggtaacgtgcgtcgtcgtcgatgtatcccacgaagatcccgaggtcaagttcaactggtatgtagatggggtcgaagtccataacgctaagacaaagccgagagaggaacaatatcagtcaacttatcgggtcgtgtcggtcctgaccgtacttcaccaggactggctcaatgggaaagagtacaaatgcaaggtgtccaataaggcgctgcctgcgccaattgagaaaactatctcgaaagcgaagggacagcccagagagccgcaagtatatacactgccaccctcgagagaagaaatgacgaagaatcaagtctccttgtggtgtttggtgaaggggttttacccttcagacatcgcagtggaatgggaatcgaacgggcagccagaaaacaattacaaaaccacacctcctgtccttgactccgatggctcatttttcctctattcgaagctcactgtcgacaagtcgcgctggcagcagggtaacgtctttagctgctccgtgatgcacgaggccctccacaatcattatacacagaaatcgctgtcactttcgcccggaaaatgataa

SEQ ID NO: 305 - protein, 488 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - DNA, 1524 bp, Artificial Sequence
  Description of Artificial Sequence: Synthetic polynucleotide
atgggcttcggactgtcgtggctttttctggtggcgattcttaagggggtccagtgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggaagcggaggcggagggagcggaggtggtgggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 307 - protein, 506 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 308 - DNA, 1524 bp, Artificial Sequence
  Description of Artificial Sequence: Synthetic polynucleotide
atgggcttcggactgtcgtggctttttctggtggcgattcttaagggggtccagtgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcggggaatgcggagggggagggtccgggggtggtgggagcggcggaggaggtagcggcggaggtggctcgggaggaggtgggtcgggtggtgggggaagcggaggcggagggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgaagtcatgcgacaagacttgataa

SEQ ID NO: 309 - protein, 506 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 310 - DNA, 1509 bp, Artificial Sequence
  Description of Artificial Sequence: Synthetic polynucleotide
atgggcttcggactgtcgtggctttttctggtggcgattcttaagggggtccagtgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggaagcggaggcggagggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 311 - protein, 501 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 312 - DNA, 1494 bp, Artificial Sequence
  Description of Artificial Sequence: Synthetic polynucleotide
atgggcttcggactgtcgtggctttttctggtggcgattcttaagggggtccagtgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcaaatcatgcgacaagaccgggggtggtgggagcggcggaggaggtagcggcggaggtggctcgggaggaggtgggtcgggtggtgggggatcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 313 - protein, 496 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 314 - DNA, 1539 bp, Artificial Sequence
  Description of Artificial Sequence: Synthetic polynucleotide
atgggcttcggactgtcgtggctttttctggtggcgattcttaagggggtccagtgcgacaaaacgcacacttgtccgccctgccctgcgcccgaactgcttggaggcccttcggtgtttttgtttccgcccaagcctaaggacaccttgatgatcagccggacaccggaggtcacatgtgtcgtcgtggatgtctcgcacgaggatcccgaggtcaagtttaactggtatgtggatggagtggaggtccacaacgccaaaaccaagcccagggaggagcaataccagtcaacctatcgggtagtctcggtgctgacggtactgcaccaggactggttgaatggaaaagagtacaaatgcaaggtatcaaacaaggcccttcccgctcccatcgaaaagacgatcagcaaagcgaaagggcaacccagagagccccaagtctatacgctgcctccctcaagggaagaaatgacgaaaaaccaggtgcacttgacatgcctcgtgaaaggcttctacccgagcgacattgcggtggaatgggagtcaaatggtcagccggaaaacaactacaagacaactccaccggtccttgattcagacgggtcgttcgccctctatagcaaactcacggtcgacaagtcccgctggcagcagggtaacgtgttttcgtgttcagtgatgcacgaggctctgcataatcactacacacagaagtccctctccttgagcaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtcccccttgtccagcgccggagctgttgggcggaccttcggtattcttgtttcctcctaagcccaaagatacgcttatgatctcccgcaccccggaggtaacttgcgtcgtagtggatgtatcacatgaggacccagaagtcaagttcaattggtacgtggacggagtcgaagtccataacgctaaaacgaaaccgagagaggaacagtatcagagcacctaccgggtagtgagcgtgctcacagtgttgcatcaggattggctgaatgggaaggaatacaagtgcaaagtgtcgaataaggcattgccagcaccgattgagaaaacaatctcaaaagcgaagggacagccccgagagcctcaagtcactacactgccacccagccgcgaagagatgacaaagaatcaggtatccctcacgtgtcttgtgaaggggttctatccctccgatatcgcagtagagtgggaatcgaacgggcagccggagaacaattacaagactttcccgccagtgcttgattcggacggtagcttctttttgtattcgaagctcacggtagataagtcgaggtggcaacaaggaaatgtgttttcatgttcggtgatgcatgaagcgctccataaccactatacgcagaaatcgctttcgctctccggtgaatgctgataa

SEQ ID NO: 315 - protein, 511 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 316 - DNA, 1539 bp, Artificial Sequence
  Description of Artificial Sequence: Synthetic polynucleotide
atgggcttcggactgtcgtggctttttctggtggcgattcttaagggggtccagtgcgacaaaacgcacacttgtccgccgtgcccagcgcccgagttgcttggcggacccagcgtgtttttgtttcccccgaaaccgaaagatacattgatgattagcagaacgcccgaagtgacgtgtgtagtagtcgacgtgtcgcacgaagatccggaggtgaagttcaactggtatgtcgatggggtagaggtgcacaacgcgaaaaccaagcccagggaggagcagtaccagtcgacatatcgggtcgtgtcagtgctgacagtgctccatcaggactggttgaacgggaaggagtataagtgtaaagtcagcaacaaagccctccccgcacccatcgagaaaaccatttccaaggcaaagggacaaccgagggaaccacaagtctacactctcccaccctcccgcgaagaaatgacgaaaaaccaagtgtcactgacgtgtcttgtagatggtttctacccctcggacatcgcggtcgaatgggagtcgaatggacagccggagaacaattacgataccacacctcctgtcttggattcggacggctcattcttcctttacagcgatctcactgtcgacaagtcgcgctggcagcagggaaacgtcttttcctgttcggtaatgcacgaagctctgcacaatcactacacgcagaagtcgctttcactttccaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtcccccttgtccagcgccggagctgttgggcggaccttcggtattcttgtttcctcctaagcccaaagatacgcttatgatctcccgcaccccggaggtaacttgcgtcgtagtggatgtatcacatgaggacccagaagtcaagttcaattggtacgtggacggagtcgaagtccataacgctaaaacgaaaccgagagaggaacagtatcagagcacctaccgggtagtgagcgtgctcacagtgttgcatcaggattggctgaatgggaaggaatacaagtgcaaagtgtcgaataaggcattgccagcaccgattgagaaaacaatctcaaaagcgaagggacagccccgagagcctcaagtctatacactgccgccaagccggaagaagatgaccaaaaaccaggtgtccctcacgtgcctcgtgaaagggttttacccgtcagatatcgccgtagaatgggagagcaatgggcagcccgagaataactataagactacgccccctgtactcaaatcggacgggtcattctttctgtattcgaagctcacggtagataagtcgaggtggcaacaaggaaatgtgttttcatgttcggtgatgcatgaagcgctccataaccactatacgcagaaatcgctttcgctctccggtgaatgctgataa

SEQ ID NO: 317 - protein, 511 aa, Artificial Sequence
  Description of Artificial Sequence: Synthetic polypeptide
MGFGLSWLFLVAILKGVQCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 318 - DNA, 1530 bp, Artificial Sequence
  Description of Artificial Sequence: Synthetic polynucleotide
atgggcttcggactgtcgtggctttttctggtggcgattcttaagggggtccagtgcgacaagacccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaatgataa

SEQ ID NO: 319 - protein, 508 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 320 - DNA, 1530 bp, Artificial Sequence
  Description of Artificial Sequence: Synthetic polynucleotide
atgggcttcggactgtcgtggctttttctggtggcgattcttaagggggtccagtgcgataagacacacacgtgcccctcgtgccccgcaccggagttccttgggggtccgtcggtctttttgtttccccctaaacccaaggacacgctcatgatctcccgcacaccggaagtcacgtgcgtagtcgtggatgtctcacaagaggacccggaagtgcaattcaactggtacgtcgacggcgtggaggtgcacaatgccaagacgaaaccaagagaggaacagttcaactcaaagtaccgggtagtatcggtgttgacggtgctccatcaggattggcttaacggtaaagagtacaagtgtaaagtcagcaataagggtctgcccagctccatcgaaaagactatctccaaggccaaggggcagcctcgcgaaccgcaagtgtgtacgttgcccccgtcccgggaggagatgacgaaaaatcaggtcagcctctcgtgtgcggtgaaggggttttacccatccgacattgcggtggaatgggagagcaacggacagcccgaaaacaattacaagactaccccgccagtactcgatagcgacgggtcgttctttcttgtgtcgaaactgacagtggacaagtcaagatggcagcaaggaaatgtgttctcgtgtagcgtgatgcacgaggcactccacaatcattacacacagaagagcttgtccctctcccctggtaaaggaggaggagggtcgggtgggggaggcagcgggggaggaggatcaggaggtgggggttcaggcggagggggttcgggtggtgggggatcgggaggtggaggttcgggaggagggggctcctgtccgagctgccccgctcccgagttcttgggaggtccctcagtgtttcttttcccgccgaagcctaaagatacactgatgatttcacgaacccccgaagtgacatgcgtagtagtagatgtgtcgcaagaagatccggaagtccagttcaattggtatgtggatggggtggaggtccataatgcgaaaacaaaaccgcgggaagagcaattcaattcaaagtatagggtcgtcagcgtgctcacagtgctgcaccaggactggcttaatgggaaagaatacaagtgcaaggtatccaacaaggggttgccctcgtcgatcgagaaaacgatttcaaaagccaagggacaaccgagggaaccacaagtatgcacgctgccgccgtgtagggaagaaatgacgaagaaccaagtgagcctctggtgcctggtgaagggcttttatccctccgacatcgcagtcgagtgggaatcgaatgggcagccggagaacaactataagactactcccccagtgttggattcggatggatcatttttcctctactcgaaacttacggtcgacaaatcacgctggcagcagggcaacgtgttttcctgctcggtaatgcatgaggcgcttcacaaccactatacccagaagtcactgtcgcttagcccagggaaatgataa

SEQ ID NO: 321 - protein, 508 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVCTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - DNA, 1530 bp, Artificial Sequence
  Description of Artificial Sequence: Synthetic polynucleotide
atgggcttcggactgtcgtggctttttctggtggcgattcttaagggggtccagtgcgacaagacccatacgtgcccatcgtgccccgcaccggagttcctcggaggcccgtcagtattcctttttcctccgaagcccaaagatacattgatgatcagcaggacgcctgaagtgacatgtgtagtggtagacgtgtcgcaagaagatccagaggtacagtttaactggtatgtcgacggggtggaagtccataacgccaagactaaaccccgcgaagagcagttcaactcaaagtatagagtagtctccgtcctgacagtcctccatcaggactggctgaacgggaaagaatacaagtgcaaagtctcgaacaaagggcttccgtcatcgatcgagaaaacgatttcaaaagccaagggacagcctagggagccgcaagtgtatactctgcccccgtcgcgcgaggagatgacgaaaaatcaggtgtccctcacgtgcctcgtcaaaggattttacccgtcggatatcgccgtggagtgggaatcgaatgggcaaccagagaacaactacaagaccactcccccggtgctggactcggacggctcctttttcttgacatcaaagctcacagtcgataagagccgctggcaacaagggaatgtgttcagctgctcggtgatgcacgaagcgctgcacaaccactatacccagaaatcattgtccctcagccccggaaagggaggtggagggtccggtgggggtggatcaggagggggtgggagcggaggaggcggcagcggtggcggagggtcaggtggaggcggatcaggtgggggaggttcaggcggtgggggctcgtgccccagctgtcctgctcccgagtttctcgggggaccttcagtctttctcttccctccgaaacccaaggacacgctgatgatttcgcggacacccgaagtgacttgtgtcgtggtcgacgtaagccaggaggaccccgaggtgcaattcaactggtacgtcgacggagtcgaggtccacaatgcgaaaacaaaacccagagaagaacagttcaattcgaaatatcgagtggtatcagtcctgaccgtgcttcatcaggattggctcaatgggaaagagtacaaatgcaaggtatcaaacaagggactgccaagctcaatcgaaaagactatctcgaaagcaaagggtcagcctcgggagccccaagtgtacacgcttcccccatccagggaagaaatgacgaagaaccaggtgtcgctctactgtttggtgaaggggttttatccttcggacatcgcggtggaatgggagtcgaatggacagccggagaataactacaaaacgactccgcctgtcctcgacagcgatgggtccttcttcctttactcaaaattgacagtagataagtcgcgctggcagcagggaaatgtattctcctgttccgtcatgcatgaggcgcttcacaatcactacactcagaagtccttgtcgttgtcaccaggaaaatgataa

SEQ ID NO: 323 - protein, 508 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLTSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 324 - DNA, 1530 bp, Artificial Sequence
  Description of Artificial Sequence: Synthetic polynucleotide
atgggcttcggactgtcgtggctttttctggtggcgattcttaagggggtccagtgcgacaagacatgctgttgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgactaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaatgataa

SEQ ID NO: 325 - protein, 508 aa, Artificial Sequence
  Description of Artificial Sequence: Synthetic polypeptide
MGFGLSWLFLVAILKGVQCDKTCCCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - DNA, 1530 bp, Artificial Sequence
  Description of Artificial Sequence: Synthetic polynucleotide
atgggcttcggactgtcgtggctttttctggtggcgattcttaagggggtccagtgcgacaagtgccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaggcggaggtgggtcgggcggagggggaagcggtggaggagggtcaggaggtggaggttccgggggaggcggttcgggaggagggggttcgggtggtggaggatcgggtggcggaggaagctgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaatgataa

SEQ ID NO: 327 - protein, 508 aa, Artificial Sequence
  Description of Artificial Sequence: Synthetic polypeptide
MGFGLSWLFLVAILKGVQCDKCHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - DNA, 1539 bp, Artificial Sequence
  Description of Artificial Sequence: Synthetic polynucleotide
atgggcttcggactgtcgtggctttttctggtggcgattcttaagggggtccagtgcgataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcgaagtatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcaaatacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 329 - protein, 511 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 330 - DNA, 1524 bp, Artificial Sequence
  Description of Artificial Sequence: Synthetic polynucleotide
atgggcttcggactgtcgtggctttttctggtggcgattcttaagggggtccagtgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcgggtggtgggggaagcggaggcggagggtcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 331 - protein, 506 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 332 - DNA, 1524 bp, Artificial Sequence
  Description of Artificial Sequence: Synthetic polynucleotide
atgggcttcggactgtcgtggctttttctggtggcgattcttaagggggtccagtgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgggggaatgcggagggggagggtccggagggggagggtccgggggtggtgggagcggcggaggaggtagcggcggaggtggctcgggaggaggtgggtcgggtggtgggggatcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgaagtcatgcgacaagacttgataa

SEQ ID NO: 333 - protein, 506 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKT

SEQ ID NO: 334 - DNA, 1509 bp, Artificial Sequence
  Description of Artificial Sequence: Synthetic polynucleotide
atgggcttcggactgtcgtggctttttctggtggcgattcttaagggggtccagtgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcgggtggtgggggatcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 335 - protein, 501 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 336 - DNA, 1494 bp, Artificial Sequence
  Description of Artificial Sequence: Synthetic polynucleotide
atgggcttcggactgtcgtggctttttctggtggcgattcttaagggggtccagtgcgacaaaacgcacacctgtccgtcatgtcctgccccggaattccttggagggccttccgtgtttctcttccctccgaagcccaaggacacgctgatgatctcccggaccccggaggtcacgtgtgtggtagtagacgtgtcacaagaagatccggaggtgcagttcaactggtacgtagatggcgtggaggtgcacaacgccaaaacgaagccccgagaggaacagttcaattcgaagtaccgcgtcgtgtcggtattgactgtattgcatcaagactggttgaacgggaaggagtataagtgtaaagtcagcaacaagggacttccctcgtcaattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgtcgaaaagctgcgacaagacgggagggggagggtccgggggtggtgggagcggcggaggaggtagcggcggaggtggctcgggaggaggtgggtcatgtccgagctgcccggcacccgaatttctcggaggtccctcggtgttcctgttcccgccaaagcctaaggatacgttgatgatttcgcgcacgccggaggtaacatgcgtggtggtggatgtgtcacaagaggaccccgaggtccagttcaattggtacgtcgatggagtggaagtgcacaatgcgaaaacaaaaccccgggaggagcagttcaatagcaagtacagggtagtctccgtcctgactgtacttcaccaagactggcttaacggaaaagagtataagtgcaaggtcagcaacaaggggcttccttcatccatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgggagagtgttgataa

SEQ ID NO: 337 - protein, 496 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 338 - DNA, 1539 bp, Artificial Sequence
  Description of Artificial Sequence: Synthetic polynucleotide
atgggcttcggactgtcgtggctttttctggtggcgattcttaagggggtccagtgcgacaaaacgcacacttgtccttcctgccctgccccggagttccttggcggaccctcggtctttttgtttccgccgaaaccgaaagacacccttatgattagcaggacacccgaagtcacgtgtgtcgtcgtggacgtgtcgcaagaggatcccgaggtgcagttcaactggtacgtggacggggtagaagtccacaatgccaagacaaaaccccgggaagaacagtttaactcgaagtaccgcgtagtgtcagtcttgacagtcctccatcaggactggcttaacgggaaggagtacaaatgtaaagtgtcaaacaagggtctgccttccagcattgagaaaacgatctccaaggctaaagggcagccccgagaaccacaagtctatacgcttccaccatcgcgggaggagatgaccaagaaccaggtccacttgacctgtctcgtgaaggggttctacccgtcagatatcgcggtagagtgggaatcgaacggccagcccgagaataactacaagacgactcctccggtcctcgattcagatgggtcgttcgcactctactcaaaacttacggtggacaagtcgagatggcagcagggcaacgtgtttagctgctcagtcatgcacgaggcgctgcataatcactatacacagaagtcgctgtcattgtcaaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtccgtcgtgccctgcaccggaattcttgggcggtccgtcagtgttcctgtttcccccgaaacccaaagatacgctcatgatttcccgcacccctgaggtcacttgcgtggtagtcgatgtcagccaggaagatcccgaagtacagttcaattggtacgtagatggtgtagaagtacacaacgctaaaactaagcctcgcgaagagcagttcaattcgaagtatcgggtagtaagcgtgctgactgtgctccatcaagactggctgaatggaaaagagtataagtgcaaagtctcgaataagggattgcccagctccatcgagaaaaccatctcgaaagcgaagggacagcccagagaaccccaagtgaccacattgccaccctcccgagaggaaatgactaagaatcaagtgtcactcacatgtcttgtgaagggattctatcccagcgacatcgccgtcgagtgggagtccaatgggcagccggaaaacaattacaaaacgtttccacccgtccttgactcagatggatcgttctttctctattcgaagctcacggtagataagtcgaggtggcaacaaggaaatgtgttttcatgttcggtgatgcatgaagcgctccataaccactatacgcagaaatcgctttcgctctccggtgaatgctgataa

SEQ ID NO: 339 - protein, 511 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVTTLPPSREEMTKNQVSLTCLVKGFYPSDIAVEWESNGQPENNYKTFPPVLDSDGSFFLYSKLTVDKSRWQQGNVFSCSVMHEALHNHYTQKSLSLSGEC

SEQ ID NO: 340 - DNA, 1539 bp, Artificial Sequence
  Description of Artificial Sequence: Synthetic polynucleotide
atgggcttcggactgtcgtggctttttctggtggcgattcttaagggggtccagtgcgacaaaacgcacacttgtccttcctgccctgccccggagttccttggcggaccctcggtctttttgtttccgccgaaaccgaaagacacccttatgattagcaggacacccgaagtcacgtgtgtcgtcgtggacgtgtcgcaagaggatcccgaggtgcagttcaactggtacgtggacggggtagaagtccacaatgccaagacaaaaccccgggaagaacagtttaactcgaagtaccgcgtagtgtcagtcttgacagtcctccatcaggactggcttaacgggaaggagtacaaatgtaaagtgtcaaacaagggtctgccttccagcattgagaaaacgatctccaaggctaaaggacagccaagagagcctcaagtctatacattgcccccgagccgggaggaaatgaccaaaaaccaggtatcgcttacgtgcttggtggacgggttttacccttcagacatcgcagtggagtgggaatccaacgggcagccagagaacaattacgataccactccacccgtgcttgacagcgatggctcattcttcctctattccgacttgaccgtcgataagtcacgatggcagcaggggaatgtgtttagctgttcggtcatgcacgaagcgctgcacaaccactacacgcagaagtcgctctcattgtccaaaagctgcgacaagacagggggtggaggttcaggcggtggtgggtcgggagggggagggtcaggtggaggcggcagcgggggtgggggatcgggaggaggagggtccgggggagggggttccggagggggtgggtcctgtccgtcgtgccctgcaccggaattcttgggcggtccgtcagtgttcctgtttcccccgaaacccaaagatacgctcatgatttcccgcacccctgaggtcacttgcgtggtagtcgatgtcagccaggaagatcccgaagtacagttcaattggtacgtagatggtgtagaagtacacaacgctaaaactaagcctcgcgaagagcagttcaattcgaagtatcgggtagtaagcgtgctgactgtgctccatcaagactggctgaatggaaaagagtataagtgcaaagtctcgaataagggattgcccagctccatcgagaaaaccatctcgaaagcgaagggacagcccagagaaccccaagtgtatacgcttcccccttcaagaaagaagatgactaagaatcaggtgtcactcacgtgcctcgtgaagggattctatccgtcggacatcgcggtcgaatgggagtcgaatggacagccggagaacaactacaagacaacacctccagtgctgaaatcggatgggagcttctttctgtattcgaagctcacggtagataagtcgaggtggcaacaaggaaatgtgttttcatgttcggtgatgcatgaagcgctccataaccactatacgcagaaatcgctttcgctctccggtgaatgctgataa

SEQ ID NO: 341 - protein, 511 aa, Artificial Sequence
  Description of Artificial Sequence: Synthetic polypeptide
MGFGLSWLFLVAILKGVQCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSGEC

SEQ ID NO: 342 - DNA, 2907 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgacaaaacgcacacctgtccgccctgtcctgccccggaacttctcggagggccttccgtgtttctcttccctccgaagcccaaggacacgctgatgatctcccggaccccggaggtcacgtgtgtggtagtagacgtgtcacacgaagatccggaggtgaagttcaactggtacgtagatggcgtggaggtgcacaacgccaaaacgaagccccgagaggaacagtaccagtcaacgtaccgcgtcgtgtcggtattgactgtattgcatcaagactggttgaacgggaaggagtataagtgtaaagtcagcaacaaggctcttcccgcacccattgaaaagacaatttcgaaagccaaaggccagcccagggagccccaagtgtacaccctgccacccagccgggaagagatgacaaagaatcaagtctcgcttagctgcgctgtcaagggcttctatccatcggacattgcagtggaatgggaatcaaacggacagccggagaataactataagacgacaccccctgtcctcgacagcgacgggtcgttcttccttgtgagcaagctcacggtcgacaaaagccgctggcagcagggaaacgtattctcatgttcggtgatgcacgaagcattgcataaccactacacgcagaagagcttgtcgttgagcggggaatgcggagggggagggtccgggggtggtgggagcggcggaggaggtagcggcggaggtggctcgggaggaggtgggtcgggtggtgggggaagcggaggcggagggtcatgtccgccgtgcccggcacccgaactgctcggaggtccctcggtgttcctgttcccgccaaagcctaaggatacgttgatgatttcgcgcacgccggaggtaacatgcgtggtggtggatgtgtcacatgaggaccccgaggtcaagttcaattggtacgtcgatggagtggaagtgcacaatgcgaaaacaaaaccccgggaggagcagtatcagagcacgtacagggtagtctccgtcctgactgtacttcaccaagactggcttaacggaaaagagtataagtgcaaggtcagcaacaaggcgcttcctgcccctatcgagaaaaccatctcgaaggccaagggacagccgagggagcctcaagtatacacgctgccgccatcgagagaagaaatgaccaaaaaccaggtgtccctttggtgtttggtgaagggtttctatccctccgatatcgccgtagagtgggagtcaaatggacagcctgagaacaactataagactacgccccctgtgttggacagcgatgggtcattctttctgtattcgaaactcacggtggataagtcgcgatggcaacagggcaatgtgttttcgtgcagcgtgatgcatgaggcgctgcacaaccactatactcagaaatcgttaagcttatcgaagtcatgcgacaagactggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 343 - protein, 969 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSGECGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSKSCDKTGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 344 - DNA, 714 bp, Artificial Sequence
  Description of Artificial Sequence: Synthetic polynucleotide
atggggacccctgcgcagttgcttttcctcctccttctctggttgcccgacacgacaggagacatcgtgctgacccagtcaccggattcgcttgcagtctcactgggagagagagccacgatcaattgcaagtcctcggaatcagtggacagctacgctaactcattcatgcactggtatcagcagaagcctggccagccgcccaagttgctgatctaccgcgcaagcacacgggagtcgggggtgccagataggttttccggatcgggttcccgaacggacttcacactcacgatttcatccttgcaagccgaagatgtggcggtctattactgtcaacagtcgaaagaggatccccttacttttggtgggggtactaaagtagagattaagcgtacggtggcagcgccgtcagtctttatcttccctccttcggatgagcagcttaagagcgggacagcctcagtagtctgccttctcaacaacttttacccgagagaggccaaggtgcagtggaaggtggataatgccttgcagtcagggaactcacaagaatcggtcacagaacaggactccaaagatagcacttattccctgtcaagcacgctcactttgtccaaagcggactacgagaagcacaaagtgtacgcttgcgaggtgactcatcaaggattgtcgagccccgtaacgaagagcttcaatcggggcgagtgt

SEQ ID NO: 345 - protein, 238 aa, Artificial Sequence
  Description of Artificial Sequence: Synthetic polypeptide
MGTPAQLLFLLLLWLPDTTGDIVLTQSPDSLAVSLGERATINCKSSESVDSYANSFMHWYQQKPGQPPKLLIYRASTRESGVPDRFSGSGSRTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - DNA, 2913 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgataagacccacacatgccctccctgtccagcacccgagctgctcgggggaccctcggtgttcttgtttcctcccaaacccaaagatacccttatgattagccggacaccagaggtgacgtgcgtggtagtagacgtgtcccatgaggacccggaggtcaagttcaactggtacgtggacggagtggaggtgcacaatgcaaagaccaagccgagggaagagcaataccagtccacatatagagtcgtgtcggtccttacggtcttgcatcaggactggctgaatggcaaagaatacaaatgtaaagtctccaacaaagctctcccagcgcccattgagaaaacaatctcaaaagcgaaaggccaaccgagagaacctcaagtctatactcttcccccgtcgagagaggaaatgaccaaaaaccaggtatccctgtcatgcgcggtcaaggggttttacccaagcgacatcgccgtggagtgggagtcgaacggacagccagagaataactataagacgacccctcccgtgctggattcggatggatcgttctttcttgtcagcaaactcacagtcgacaaatcaaggtggcagcaagggaacgtgttcagctgttcggtaatgcatgaagccctccacaatcactacacgcagaaatccctgtcgctctcaccagggaagactagacccgctccaccctcaaccgcgacaacagccggctcgacgcctcagcccgaatcggcctcaccgtcgggcaaagagcctgcggcatcgtcgccctcgtcaaccaatacaggctcatgtccgccgtgccctgcccccgaattgctgggaggtccgtccgtatttctgtttcccccgaagcctaaagatactcttatgatctcgcgaacgccggaagtaacttgtgtcgtggtagatgtctcacacgaagatcccgaagtgaaattcaattggtatgtcgacggcgtggaggtacataacgccaagacgaagcctagagaggaacagtaccagtcaacgtatcgggtcgtatccgtgctcaccgtgctccaccaggattggctgaacggaaaggagtacaagtgcaaagtctcgaacaaggcgttgcctgcgccaatcgaaaagacgatctccaaagctaagggacaaccaagggaaccacaagtgtatactctcccgccctcgcgcgaagagatgacaaagaatcaggtgtcactttggtgcttggtgaaggggttctatccctcggatattgcggtcgagtgggagagcaatggtcaaccggagaacaattacaagacgacaccgcccgtattggactccgacgggtccttctttctctactcgaagctcactgtagataagtcgcgatggcagcaggggaacgtctttagctgttccgtgatgcacgaggcacttcataaccactatacccagaagtcgttgtcgctttcccccggaaaaggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 347 - protein, 971 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKTRPAPPSTATTAGSTPQPESASPSGKEPAASSPSSTNTGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 348 - DNA, 2913 bp, Artificial Sequence
  Description of Artificial Sequence: Synthetic polynucleotide
gaggtgcaactggtagaaagcggaggtggtcttgtacagcccggtggttcactcagactgtcgtgcgcagcttcagggtatacgttcacctcctactggctccattgggtgcgacaggctccggggaaaggactggaatgggtcgggatgattgatccgtcgaattcggatactaggttcaatcccaacttcaaggaccggtttaccattagcgcggatacctcgaaaaacaccgcatatctccaaatgaactcgttgagagccgaggacacggcggtgtattactgcgcaagatacgggtcgtatgtgtcaccgttggactactggggccaggggacactggtaacggtcagctcagctagcacgaagggacctagcgtgttcccattggcgcccagctcgaaatccacatcgggcggaacggcagcccttgggtgcctcgtgaaagactactttcccgaaccggtgactgtgtcgtggaattcaggggcattgacttccggtgtccacacatttccagccgtgctgcagtccagcgggttgtattcgctctcgtcagtggtcacagtcccatcctcctcgctcggaacacaaacctatatctgtaatgtcaaccataaaccttcaaatacaaaagtggacaaaaaggtagaaccgaaatcatgcgacaagacccatacatgcccaagctgtcccgctccggagtttctcggtggaccgtcggtgtttctgttccctccgaagccaaaagataccttgatgatttcgcgaactcccgaagtcacgtgtgtcgtcgtggacgtaagccaggaggacccggaggtccagttcaattggtatgtagacggcgtagaggtacataatgcgaaaacgaagcccagagaggaacagttcaatagcaaataccgcgtagtatcggtgctgacagtgttgcaccaggactggctgaatggaaaagaatacaagtgtaaagtgtccaacaagggccttccatcgtcgattgaaaagacaatctccaaggcaaaggggcagcctagggagccccaagtctacaccctgcccccttcgcgggaggagatgacgaagaaccaggtatcactgtcatgcgcggtcaaaggattttacccgagcgacatcgccgtagaatgggagtccaacggacagccagaaaacaattacaagaccactcctccagtgctcgatagcgatggctccttctttcttgtcagcaaattgacagtcgataagtcaagatggcagcagggtaatgtgttctcatgtagcgtcatgcacgaagcactccacaatcattatacacagaagagcctctcgttgtcgcccggaaaaactagacccgctccaccctcaaccgcgacaacagccggctcgacgcctcagcccgaatcggcctcaccgtcgggcaaagagcctgcggcatcgtcgccctcgtcaaccaatacaggctcatgcccttcatgtccagcccccgagttcctcggaggcccgtcggtctttctttttccccctaagcctaaagataccctgatgatcagccggacgcctgaggtgacttgtgtggtagtcgacgtgtcccaagaagatccggaagtccagtttaactggtatgtggatggagtggaggtccataatgccaagacaaagccaagggaggagcaattcaactcgaagtaccgcgtcgtgtccgtgctcacagtgcttcatcaagactggttgaacggaaaggagtacaaatgtaaggtatcaaacaagggtttgccctcgtccatcgagaaaaccatctcgaaagcgaaagggcaaccccgcgagccccaggtatatacgctcccgccttcaagagaagaaatgacgaaaaaccaagtgagcttgtggtgcctggtcaaggggttctatccctccgatatcgcggtagagtgggaaagcaatgggcagccggagaacaactataagacaacgcctcccgtgttggactcagatggatcgttcttcttgtactcaaagcttacggtggacaagtcacgctggcagcaagggaacgtgttttcgtgctcggtgatgcacgaggcgcttcacaatcactacactcagaaatcgcttagcttgtcaccaggaaaaggaggtggagggagcggtggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaact

SEQ ID NO: 349 - protein, 971 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKTRPAPPSTATTAGSTPQPESASPSGKEPAASSPSSTNTGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 350 - protein, 983 aa, Artificial Sequence
  Description of Artificial Sequence: Synthetic polypeptide
EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATIINDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 351 - protein, 983 aa, Artificial Sequence [sequence omitted]

SEQ ID NO: 352 - protein, 975 aa, Artificial Sequence
  Description of Artificial Sequence: Synthetic polypeptide
EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATIINDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLTFGGGTKLEIK

SEQ ID NO: 353 - protein, 975 aa, Artificial Sequence
  Description of Artificial Sequence: Synthetic polypeptide
EVQLLESGGGLVQPGGSLRLSCAASGFTFSDYQMEWVRQAPGKGLEWVSYIYSSGGKTVYADSVKGRFTISRDNSKNTLYLQMNSLRAEDTAVYYCARLPRVGATIINDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLTFGGGTKLEIK

SEQ ID NO: 354 - protein, 980 aa, Artificial Sequence [sequence omitted]

SEQ ID NO: 355 - protein, 976 aa, Artificial Sequence [sequence omitted]

SEQ ID NO: 356 - protein, 980 aa, Artificial Sequence
  Description of Artificial Sequence: Synthetic polypeptide
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGSGGGGSGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIK

SEQ ID NO: 357 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 358 - DNA, 1482 bp, Artificial Sequence
  Description of Artificial Sequence: Synthetic polynucleotide
gacaaaacccacacatgcccctcatgtccagctccagagttcctgggaggaccaagcgtgttcctgtttccacctaagcctaaagataccctgatgatttccaggactccagaagtgacctgcgtggtggtggacgtgtctcaggaggaccccgaagtgcagttcaactggtacgtggacggcgtggaggtgcacaatgccaagacaaaacctcgggaggaacagtttaatagcacttacagagtggtgtctgtgctgactgtgctgcatcaggattggctgaacggaaaggaatacaagtgcaaagtgagtaataagggcctgccatctagtatcgagaaaacaatttccaaggctaaagggcagcctcgggaaccacaggtgtacaccctgcccccttcccgggaggaaatgactaagaaccaggtgtcactgagctgcgccgtgaaaggcttctacccttccgacatcgctgtggagtgggaatctaatgggcagccagaaaacaattataagaccacaccacccgtgctggactcagatgggagcttctttctggtgtctaagctgacagtggacaaaagtagatggcagcagggcaacgtgttttcctgctctgtgatgcacgaggccctgcacaatcattacactcagaaaagtctgtcactgagcaagtcctgtgataaaaccggcggaggaggcagcggaggaggagggtccggaggcgggggatctggcgggggaggcagtgggggaggcgggtcaggaggcgggggaagcggcgggggaggctccgggggaggcgggtcctgcccctcttgtcctgccccagagttcctgggaggcccatccgtgttcctgtttcctccaaagcccaaagacaccctgatgatctctaggacaccagaagtgacttgcgtggtggtggacgtgagtcaggaggaccccgaagtgcagttcaactggtatgtggatggcgtggaggtgcacaatgctaagacaaaacctcgggaggaacagtttaatagcacttacagagtggtgtctgtgctgactgtgctgcatcaggattggctgaacgggaaggagtataagtgcaaagtgagcaataagggactgccatctagtatcgagaaaaccattagcaaggccaaaggccagcccagggaacctcaggtgtataccctgccccctagccgcgaggaaatgacaaagaaccaggtgtccctgtggtgtctggtgaaaggattctatcccagtgacattgctgtggagtgggaatcaaatggccagcctgaaaacaattacaagactaccccacccgtgctggacagtgatggctcattctttctgtattcaaagctgaccgtggataaaagcagatggcagcagggaaacgtgttttcttgcagtgtgatgcatgaggctctgcacaatcattacacacagaagagcttaagcttaagcggcgagtgctgataa

SEQ ID NO: 359 - protein, 973 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLTFGGGTKLEIK

SEQ ID NO: 360 - protein, 973 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSASTGGGGSGGGGSGGGGSGGGGSENVLTQSPSSMSVSVGDRVTIACSASSSVPYMHWLQQKPGKSPKLLIYLTSNLASGVPSRFSGSGSGTDYSLTISSVQPEDAATYYCQQRSSYPLTFGGGTKLEIK

SEQ ID NO: 361 - protein, 967 aa, Artificial Sequence [sequence omitted]

SEQ ID NO: 362 - protein, 967 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSASTGGGGSGGGGSGGGGSGGGGSEIVLTQSPATLSLSPGERATLSCSASSSINYIYWYQQKPGQAPRLLIYLTSNLASGVPARFSGSGSGTDFTLTISSLEPEDFAVYYCLQWSSNPLTFGGGTKVEIK

SEQ ID NO: 363 - protein, 978 aa, Artificial Sequence [sequence omitted]

SEQ ID NO: 364 - protein, 978 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVESGGGLVQPGGSLRLSCAASGFDFSRYWMSWVRQAPGKGLVWVGEVNPDSTSINYTPSLKDRFTISRDNAKNTLYLQMNSLRAEDTAVYYCTRPNYYGSRYHYYAMDYWGQGTLVTVSSASTGGGGSGGGGSGGGGSGGGGSDIQMTQSPSSLSASVGDRVTITCRASQDINNYLNWYQQKPGKAPKLLIYYTSRLHSGVPSRFSGSGSGTDFTFTISSLQPEDIATYYCQQGSTLPFTFGQGTKLEIK

SEQ ID NO: 365 - protein, 983 aa, Artificial Sequence
  Description of Artificial Sequence: Synthetic polypeptide
EVQLVESGGGLVQPGGSLRLSCAASGFDFSRYWMSWVRQAPGKGLVWVGEVNPDSTSINYTPSLKDRFTISRDNAKNTLYLQMNSLRAEDTAVYYCTRPNYYGSRYHYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGEVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTGGGGSGGGGSGGGGSGGGGSDIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIK

SEQ ID NO: 366 - protein, 984 aa, Artificial Sequence [sequence omitted]

SEQ ID NO: 367 - protein, 214 aa, Artificial Sequence
  Description of Artificial Sequence: Synthetic polypeptide
DIQMTQSPSSLSASVGDRVTITCRASQDINNYLNWYQQKPGKAPKLLIYYTSRLHSGVPSRFSGSGSGTDFTFTISSLQPEDIATYYCQQGSTLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 368 - protein, 711 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - DNA, 2139 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcaccaagggacccagcgtgtttccacttgcgccttcgtcaaagtccacaagcgggggaacggcagcccttggctgcctggtgaaagactactttcccgaacccgtgacagtatcgtggaatagcggagcgctcacatcgggcgtgcacacatttccggcggtgctgcagtcctccgggttgtattcgctgtcgagcgtagtcacggtgccgtcctcgtcactgggaactcagacatacatttgcaacgtcaatcacaaaccgtcaaacacgaaagtcgacaagaaagtggaaccgaaatcatgcgacaagacccacacttgtcccccatgtcctgccccagagcttctcgggggaccctcggtgttcttgttcccgccgaaaccgaaagatactctcatgatcagcagaacacccgaagtcacgtgtgtcgtggtagatgtctcccacgaggaccccgaggtgaagtttaactggtatgtagacggggtagaggtacataatgcgaaaacaaaaccccgcgaagaacagtaccagtcaacttatcgcgtcgtgtcagtactcacggtcttgcatcaggactggttgaacgggaaggagtacaaatgtaaggtatcaaacaaggccctcccagcgccgattgagaaaacgatctcgaaagcgaaaggacagcccagggagccgcaagtatacactcttccgccatcacgggaggagatgactaagaaccaagtcagcctgagctgcgcggtgaaagggttctatccgtcggatattgcggtggaatgggagtcgaacggccagccggagaacaattacaaaaccacgccacccgtcctcgacagcgacggatcgttctttctggtgagcaagttgaccgtcgataagtcgcggtggcaacagggtaatgtgttttcatgctcagtgatgcatgaggccttgcacaatcattacacacagaagtccctcagcctttcgcctggcaaaggtgggggtgggtcgggagggggaggatcaggtggtggagggtcaggaggtgggggatcaggagggggtgggagcgggggaggcgggtccggaggaggcggcagcgggggtgggggctcgtgtcccccttgtccggcacccgagctcttgggaggaccttcagtgtttctttttccgcccaaacccaaagatacccttatgatctcgcgaacccctgaagtcacatgcgtggtcgtggatgtatcgcatgaggacccggaggtcaagttcaattggtacgtggacggggtcgaggtgcacaacgctaagacaaaacctcgggaggagcagtatcagtccacatatagggtcgtgtccgtactgacggtacttcatcaggattggctcaatgggaaagaatacaagtgcaaggtgtcgaataaggcgttgcctgcacccattgaaaagacgatttcgaaagctaagggtcaacccagagaaccccaagtctatacgcttcccccttcccgcgaggaaatgacgaagaatcaggtcagcctctggtgcctggtgaaggggttctacccctccgacatcgccgtagagtgggaatccaatgggcagcccgaaaacaactacaagacgacaccgcctgtgttggattcagatgggagcttctttctctattccaaactgacggtggacaaaagcaggtggcagcaaggaaatgtgttctcgtgctcggtaatgcacgaagcactgcacaaccactacacccagaagtccttgtccctttcgccaggaaaataatag

SEQ ID NO: 370 - protein, 711 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - DNA, 2138 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcaccaagggacccagcgtgtttccacttgcgccttcgtcaaagtccacaagcgggggaacggcagcccttggctgcctggtgaaagactactttcccgaacccgtgacagtatcgtggaatagcggagcgctcacatcgggcgtgcacacatttccggcggtgctgcagtcctccgggttgtattcgctgtcgagcgtagtcacggtgccgtcctcgtcactgggaactcagacatacatttgcaacgtcaatcacaaaccgtcaaacacgaaagtcgacaaaaaggtggaacctaagtcgtgcgacaaaacacacacctgcccgtcgtgtccagcgcctgagttcttgggtggtccctcggtgtttctttttccgcctaagcccaaagacacgctcatgatttcgcgcacacccgaagtcacatgcgtggtggtggatgtgagccaggaagatccggaggtacagttcaattggtatgtcgatggggtggaggtacataatgccaagacgaaaccgagggaggagcagttcaactccaagtatagggtggtgtcagtcttgactgtgttgcaccaagattggcttaacggaaaagagtataagtgtaaagtatcgaacaagggactccccagctcaatcgaaaagacgatctcaaaggcgaaaggtcagccacgagaaccccaagtatacacgctgcctccatcgcgggaagaaatgacgaaaaaccaagtatcgctttcatgcgctgtgaaggggttctacccgtcggacattgccgtggaatgggaaagcaatgggcagccagagaataactataagactacgcccccagtcttggacagcgacgggagctttttcctggtgtccaagttgacagtggacaaatcgcgctggcagcagggaaatgtgttttcctgttccgtaatgcatgaagcactccataatcactacacacagaaatcgctttcgctgtcacccgggaagggtgggggtgggtcgggagggggaggatcaggtggtggagggtcaggaggtgggggatcaggagggggtgggagcgggggaggcgggtccggaggaggcggcagcgggggtgggggctcgtgcccttcctgtcccgcacccgagttccttgggggaccgtcggtctttctcttccctccgaagcccaaggacaccttgatgatctcccggactcccgaagtgacgtgtgtcgtagtagacgtgtcgcaagaggaccccgaggtccagttcaactggtacgtcgatggcgtggaggtgcacaacgctaaaacaaagcccagagaagagcagtttaacagcaagtatcgggtcgtcagcgtgctgaccgtccttcatcaggactggcttaatggaaaggaatacaaatgtaaagtctcgaataaggggttgcccagctcgattgagaaaaccatctccaaagcgaaagggcagccaagagagcctcaagtctatacgcttcccccatcacgcgaagagatgactaagaatcaagtctccctgtggtgcctggtgaagggattctacccttcggatattgcggtggagtgggagtccaacggtcagccggagaacaattacaagacgactccgccggtactcgattcagatggatcattctttctctactccaaactcacagtagacaaatcgaggtggcaacagggaaacgtcttttcatgttcggtaatgcacgaggcccttcacaatcattacacccagaaatcactcagcctgtccccgggaaataatag

SEQ ID NO: 372 - protein, 714 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 373 - DNA, 2151 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaaggggcccagcgtctttccattggcgccctcgtcgaaatcaaccagcggaggaacagctgcgcttggttgcctcgtcaaagactacttccccgagccggtaacggtgtcgtggaactccggtgcgctgacatcaggggtgcacacgttccctgctgtccttcagtcaagcgggttgtactcgctctcgtccgtggtgacggtgccctccagctcgttgggcacgcagacttacatctgcaatgtgaaccataaacccagcaacactaaagtcgacaaaaaggtcgaaccaaaatcgtgcgataagacgcacacctgcccaccttgtccggctccggaactcttgggtggtccgtccgtattcttgttcccgcctaagccgaaggacactcttatgatttcgaggaccccggaggtcacgtgcgtcgtggtggatgtctcgcatgaggacccggaagtcaaattcaactggtacgtagacggtgtcgaggtgcataacgcaaagaccaagcccagggaagagcagtaccagtccacgtaccgggtagtgtcggtgctcaccgtgcttcaccaggactggcttaacgggaaggaatacaagtgtaaagtctccaacaaagcgctccctgcccccatcgaaaagaccatttcgaaagcgaaagggcagccacgcgagcctcaagtgtacaccctgccgccgtcccgggaagagatgactaagaatcaggtatccctctcatgcgctgtcaagggtttctacccgtcagacatcgcagtggaatgggaatcaaacggccagccggagaataactacaagacgacgccgcctgtcctcgattccgacgggtcgttcttcctggtgtcgaagttgacagtggacaagtcgcgatggcagcaaggaaacgtcttctcatgctcggtaatgcacgaggcgctccataaccactatacacagaaatcgctctccttgtcaaagtcgtgcgataagacgggagggggtggatcaggtgggggaggctcgggagggggaggaagcggtggaggagggtcaggaggaggaggcagcgggggcggtggttccggtggtgggggatcaggcggaggcggctcatgcccgccttgtcccgcaccagaactgcttggagggccttcggtctttctctttcccccgaaacccaaagacaccctgatgatctcacgcactcccgaagtcacatgtgtagtcgtcgatgtgtcgcatgaagatccggaggtgaagttcaattggtacgtagatggggtcgaagtgcataatgcaaagacgaaaccgcgagaggagcagtatcagtcaacgtatcgcgtagtaagcgtgttgacggtgctccatcaggattggttgaatggtaaagagtacaagtgcaaggtgtcaaacaaagcgttgccggcccctattgaaaagaccatctcaaaagccaaggggcaaccccgagagccccaagtatacactctcccgccttcgagagaggagatgactaaaaaccaggtgtcgctttggtgtttggtgaaggggttctatccctcggatatcgccgtcgagtgggaatccaatgggcaacccgaaaacaactataagacaacgcctccagtactggactccgacggctcctttttcttgtactccaaattgacggtggataagtcgcggtggcagcaggggaatgtgttttcgtgtagcgtgatgcatgaagccctgcataaccactatactcaaaagtcactttccctgtcgggtgaatgctgataatct

SEQ ID NO: 374 - protein, 714 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 375 - DNA, 2160 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatccggagagtgttgataatctagactcgag

SEQ ID NO: 376 - protein, 973 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRISCAVSGFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGSGGGGSGGGGSDIVLTQSPSSLSVTPGEKVTFTCRASQSIGTNIHWYQQKPGQSPKLLIKYASESISGVPSRFSGSGSGTDFTLTINSVEAEDAATYYCQQNNNWPTTFGQGTKLEIK

SEQ ID NO: 377 - DNA, 2925 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaaggggcccagcgtctttccattggcgccctcgtcgaaatcaaccagcggaggaacagctgcgcttggttgcctcgtcaaagactacttccccgagccggtaacggtgtcgtggaactccggtgcgctgacatcaggggtgcacacgttccctgctgtccttcagtcaagcgggttgtactcgctctcgtccgtggtgacggtgccctccagctcgttgggcacgcagacttacatctgcaatgtgaaccataaacccagcaacactaaagtcgacaaaaaggtcgaaccaaaatcgtgcgataagacgcacacctgcccaccttgtccggctccggaactcttgggtggtccgtccgtattcttgttcccgcctaagccgaaggacactcttatgatttcgaggaccccggaggtcacgtgcgtcgtggtggatgtctcgcatgaggacccggaagtcaaattcaactggtacgtagacggtgtcgaggtgcataacgcaaagaccaagcccagggaagagcagtaccagtccacgtaccgggtagtgtcggtgctcaccgtgcttcaccaggactggcttaacgggaaggaatacaagtgtaaagtctccaacaaagcgctccctgcccccatcgaaaagaccatttcgaaagcgaaagggcagccacgcgagcctcaagtgtacaccctgccgccgtcccgggaagagatgactaagaatcaggtatccctctcatgcgctgtcaagggtttctacccgtcagacatcgcagtggaatgggaatcaaacggccagccggagaataactacaagacgacgccgcctgtcctcgattccgacgggtcgttcttcctggtgtcgaagttgacagtggacaagtcgcgatggcagcaaggaaacgtcttctcatgctcggtaatgcacgaggcgctccataaccactatacacagaaatcgctctccttgtcaaagtcgtgcgataagacgggagggggtggatcaggtgggggaggctcgggagggggaggaagcggtggaggagggtcaggaggaggaggcagcgggggcggtggttccggtggtgggggatcaggcggaggcggctcatgcccgccttgtcccgcaccagaactgcttggagggccttcggtctttctctttcccccgaaacccaaagacaccctgatgatctcacgcactcccgaagtcacatgtgtagtcgtcgatgtgtcgcatgaagatccggaggtgaagttcaattggtacgtagatggggtcgaagtgcataatgcaaagacgaaaccgcgagaggagcagtatcagtcaacgtatcgcgtagtaagcgtgttgacggtgctccatcaggattggttgaatggtaaagagtacaagtgcaaggtgtcaaacaaagcgttgccggcccctattgaaaagaccatctcaaaagccaaggggcaaccccgagagccccaagtatacactctcccgccttcgagagaggagatgactaaaaaccaggtgtcgctttggtgtttggtgaaggggttctatccctcggatatcgccgtcgagtgggaatccaatgggcaacccgaaaacaactataagacaacgcctccagtactggactccgacggctcctttttcttgtactccaaattgacggtggataagtcgcggtggcagcaggggaatgtgttttcgtgtagcgtgatgcatgaagccctgcataaccactatactcaaaagtcactttccctgtcgggtgaatgcggcggaggtgggtccgggggtgggggatcccaggtgcagctggtggagtctggaggaggagtggtgcagccaggagaatccctgaggatttcttgtgccgtgtcaggcttcagcctgactaattacggggtgcactgggtgcgccaggctccaggcaaagggctggagtggctgggcgtgatctggtccggagggaatacagactacaacacccctttcacaagtaggctgaccatttcaaaggataactcaaaaagcacagtgtatttccagatgaacagcctgcgggccgaggacacagccgtgtactattgcgccagagctctgacttactatgattacgaattcgcctattggggacagggcactctggtgaccgtgagcagcgccagcaccggaggaggaggaagcggcggaggaggctccggaggaggcgggtctggaggcgggggaagtgacatcgtgctgactcagtcaccatctagtctgagcgtgacccccggcgagaaagtgacttttacctgccgggcctcccagtctatcggaaccaatattcattggtatcagcagaaacccggccagtcccctaagctgctgatcaaatatgctagtgaatcaattagcggcgtgcccagccggttcagcgggtctggaagtggcaccgactttacactgactatcaacagtgtggaggccgaagatgccgctacatactattgtcagcagaacaataactggcctaccacatttgggcagggaacaaagctggagatcaagtgataa

SEQ ID NO: 378 - protein, 974 aa, Artificial Sequence [sequence omitted]

SEQ ID NO: 379 - DNA, 2928 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaaggggcccagcgtctttccattggcgccctcgtcgaaatcaaccagcggaggaacagctgcgcttggttgcctcgtcaaagactacttccccgagccggtaacggtgtcgtggaactccggtgcgctgacatcaggggtgcacacgttccctgctgtccttcagtcaagcgggttgtactcgctctcgtccgtggtgacggtgccctccagctcgttgggcacgcagacttacatctgcaatgtgaaccataaacccagcaacactaaagtcgacaaaaaggtcgaaccaaaatcgtgcgataagacgcacacctgcccaccttgtccggctccggaactcttgggtggtccgtccgtattcttgttcccgcctaagccgaaggacactcttatgatttcgaggaccccggaggtcacgtgcgtcgtggtggatgtctcgcatgaggacccggaagtcaaattcaactggtacgtagacggtgtcgaggtgcataacgcaaagaccaagcccagggaagagcagtaccagtccacgtaccgggtagtgtcggtgctcaccgtgcttcaccaggactggcttaacgggaaggaatacaagtgtaaagtctccaacaaagcgctccctgcccccatcgaaaagaccatttcgaaagcgaaagggcagccacgcgagcctcaagtgtacaccctgccgccgtcccgggaagagatgactaagaatcaggtatccctctcatgcgctgtcaagggtttctacccgtcagacatcgcagtggaatgggaatcaaacggccagccggagaataactacaagacgacgccgcctgtcctcgattccgacgggtcgttcttcctggtgtcgaagttgacagtggacaagtcgcgatggcagcaaggaaacgtcttctcatgctcggtaatgcacgaggcgctccataaccactatacacagaaatcgctctccttgtcaaagtcgtgcgataagacgggagggggtggatcaggtgggggaggctcgggagggggaggaagcggtggaggagggtcaggaggaggaggcagcgggggcggtggttccggtggtgggggatcaggcggaggcggctcatgcccgccttgtcccgcaccagaactgcttggagggccttcggtctttctctttcccccgaaacccaaagacaccctgatgatctcacgcactcccgaagtcacatgtgtagtcgtcgatgtgtcgcatgaagatccggaggtgaagttcaattggtacgtagatggggtcgaagtgcataatgcaaagacgaaaccgcgagaggagcagtatcagtcaacgtatcgcgtagtaagcgtgttgacggtgctccatcaggattggttgaatggtaaagagtacaagtgcaaggtgtcaaacaaagcgttgccggcccctattgaaaagaccatctcaaaagccaaggggcaaccccgagagccccaagtatacactctcccgccttcgagagaggagatgactaaaaaccaggtgtcgctttggtgtttggtgaaggggttctatccctcggatatcgccgtcgagtgggaatccaatgggcaacccgaaaacaactataagacaacgcctccagtactggactccgacggctcctttttcttgtactccaaattgacggtggataagtcgcggtggcagcaggggaatgtgttttcgtgtagcgtgatgcatgaagccctgcataaccactatactcaaaagtcactttccctgtcgggtgaatgcggcggaggtgggtccgggggtgggggatcccaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaacttgataa

SEQ ID NO: 380 - protein, 981 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 381 - DNA, 2949 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaaggggcccagcgtctttccattggcgccctcgtcgaaatcaaccagcggaggaacagctgcgcttggttgcctcgtcaaagactacttccccgagccggtaacggtgtcgtggaactccggtgcgctgacatcaggggtgcacacgttccctgctgtccttcagtcaagcgggttgtactcgctctcgtccgtggtgacggtgccctccagctcgttgggcacgcagacttacatctgcaatgtgaaccataaacccagcaacactaaagtcgacaaaaaggtcgaaccaaaatcgtgcgataagacgcacacctgcccaccttgtccggctccggaactcttgggtggtccgtccgtattcttgttcccgcctaagccgaaggacactcttatgatttcgaggaccccggaggtcacgtgcgtcgtggtggatgtctcgcatgaggacccggaagtcaaattcaactggtacgtagacggtgtcgaggtgcataacgcaaagaccaagcccagggaagagcagtaccagtccacgtaccgggtagtgtcggtgctcaccgtgcttcaccaggactggcttaacgggaaggaatacaagtgtaaagtctccaacaaagcgctccctgcccccatcgaaaagaccatttcgaaagcgaaagggcagccacgcgagcctcaagtgtacaccctgccgccgtcccgggaagagatgactaagaatcaggtatccctctcatgcgctgtcaagggtttctacccgtcagacatcgcagtggaatgggaatcaaacggccagccggagaataactacaagacgacgccgcctgtcctcgattccgacgggtcgttcttcctggtgtcgaagttgacagtggacaagtcgcgatggcagcaaggaaacgtcttctcatgctcggtaatgcacgaggcgctccataaccactatacacagaaatcgctctccttgtcaaagtcgtgcgataagacgggagggggtggatcaggtgggggaggctcgggagggggaggaagcggtggaggagggtcaggaggaggaggcagcgggggcggtggttccggtggtgggggatcaggcggaggcggctcatgcccgccttgtcccgcaccagaactgcttggagggccttcggtctttctctttcccccgaaacccaaagacaccctgatgatctcacgcactcccgaagtcacatgtgtagtcgtcgatgtgtcgcatgaagatccggaggtgaagttcaattggtacgtagatggggtcgaagtgcataatgcaaagacgaaaccgcgagaggagcagtatcagtcaacgtatcgcgtagtaagcgtgttgacggtgctccatcaggattggttgaatggtaaagagtacaagtgcaaggtgtcaaacaaagcgttgccggcccctattgaaaagaccatctcaaaagccaaggggcaaccccgagagccccaagtatacactctcccgccttcgagagaggagatgactaaaaaccaggtgtcgctttggtgtttggtgaaggggttctatccctcggatatcgccgtcgagtgggaatccaatgggcaacccgaaaacaactataagacaacgcctccagtactggactccgacggctcctttttcttgtactccaaattgacggtggataagtcgcggtggcagcaggggaatgtgttttcgtgtagcgtgatgcatgaagccctgcataaccactatactcaaaagtcactttccctgtcgggtgaatgcggcggaggtgggtccgggggtgggggttcggaggtacagctcgtccagagcggcgcagaggtcaagaaaccgggatcaagcgtcaaagtgtcatgtaaagcatcgggtgggaccttttcatcctatgcgattggttgggtccgacaagcgcctggacaggggcttgaatggatgggtggtatcatcccgattttcggaatcgccaactacgcacaaaagtttcaggggagagtgacaattacagccgatgagtcaacgtcctcagcctatatggaactctcatccctgcgcagcgaggacactgcggtctattactgtgcgcgggaagaggggccctactgctcgtcgacctcgtgctacgcggcgtttgatatctggggccagggcaccctcgtgacggtatcgtccgcgtcaacagggggtgggggttcgggcggaggaggatcgggaggaggtggatcgggtggtgggggatcacagtcagtcctgacgcaagacccagcggtatcggtggcccttggacagacagtaaagatcacgtgtcaaggggattcgttgaggtcctacttcgccagctggtatcagcagaagcccggacaggcgcccactcttgtgatgtacgcacgcaacgaccggcctgctggagtgcccgacagattctcggggtcgaaaagcggaacttcagcgtcgttggcaatttccggccttcagccggaggacgaggcggattactactgcgctgcctgggatgactcattgaatgggtatctcttcggtgcggggacgaagttgacggtgctgtgataa

SEQ ID NO: 382 - protein, 973 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVESGGGVVQPGESLRISCAVSGFSLTNYGVHWVRQAPGKGLEWLGVIWSGGNTDYNTPFTSRLTISKDNSKSTVYFQMNSLRAEDTAVYYCARALTYYDYEFAYWGQGTLVTVSSASTGGGGSGGGGSGGGGSGGGGSDIVLTQSPSSLSVTPGEKVTFTCRASQSIGTNIHWYQQKPGQSPKLLIKYASESISGVPSRFSGSGSGTDFTLTINSVEAEDAATYYCQQNNNWPTTFGQGTKLEIK

SEQ ID NO: 383 - DNA, 2925 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatccggagagtgtggcggcggaggaagcggaggaggcgggtctcaggtgcagctggtggagtctggaggaggagtggtgcagccaggagaatccctgaggatttcttgtgccgtgtcaggcttcagcctgactaattacggggtgcactgggtgcgccaggctccaggcaaagggctggagtggctgggcgtgatctggtccggagggaatacagactacaacacccctttcacaagtaggctgaccatttcaaaggataactcaaaaagcacagtgtatttccagatgaacagcctgcgggccgaggacacagccgtgtactattgcgccagagctctgacttactatgattacgaattcgcctattggggacagggcactctggtgaccgtgagcagcgccagcaccggaggaggaggaagcggcggaggaggctccggaggaggcgggtctggaggcgggggaagtgacatcgtgctgactcagtcaccatctagtctgagcgtgacccccggcgagaaagtgacttttacctgccgggcctcccagtctatcggaaccaatattcattggtatcagcagaaacccggccagtcccctaagctgctgatcaaatatgctagtgaatcaattagcggcgtgcccagccggttcagcgggtctggaagtggcaccgactttacactgactatcaacagtgtggaggccgaagatgccgctacatactattgtcagcagaacaataactggcctaccacatttgggcagggaacaaagctggagatcaagtgataa

SEQ ID NO: 384 - protein, 974 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSSASTGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGGGTKVEIKRT

SEQ ID NO: 385 - DNA, 2928 bp, Artificial Sequence
  Description of Artificial Sequence: Synthetic polynucleotide
gaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatccggagagtgtggcggcggaggaagcggaggaggcgggtctcaagtccagttgcaagaaagcgggccaggactcgtgaaaccctcggaaaccctgtcactgacgtgcacggtgagcggagggtccgtgtcgagcggagattactattggacttggattagacagtcgcccggaaaaggtctggagtggatcggacacatctactactcggggaatacgaattacaacccgtcgttgaaatcacggctcacgattagcatcgatacctccaagacgcagttctcgctcaaacttagctccgtaactgcggccgacaccgcaatctactattgtgtacgcgaccgcgtcacaggggcttttgacatttggggtcagggcactatggtgacctcgtcagcgtcgacaggtggtgggggatcaggaggaggtggctccgggggaggcggaagcggcggtgggggctccgacatccagatgacgcagtcgccctcatcattgtcagcatcagtcggggacagggtcactattacttgtcaggccagccaagatatctcgaactatctgaactggtatcagcagaagcctggaaaagcgcctaagctccttatctatgatgcgtccaatcttgagacaggggtgccgtcgcggttttccggttcagggtcgggaacggacttcacgtttacaatctccagcctgcagccggaggacgaagccacctacttctgccaacacttcgaccatttgcctcttgcgttcggaggtgggacaaaggtggagatcaagcgaacttgataa

SEQ ID NO: 386 - protein, 981 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSEVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSSASTGGGGSGGGGSGGGGSGGGGSQSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 387 - DNA, 3030 bp, Artificial Sequence
  Description of Artificial Sequence: Synthetic polynucleotide
ggtaccatgggcttcggactgtcgtggctttttctggtggcgattcttaagggggtccagtgcgaggtgcagttggtagaatcaggagggggtctggtccaacccggaggaagcctcagactcagctgtgcggcttcgggttacacctttacctcctattggttgcactgggtgagacaggcacctggcaaagggctcgaatgggtcggaatgatcgacccctccaactcagatacgcggtttaacccgaatttcaaggatcgattcacgatctcagcagacacatcgaaaaacacagcgtacctccagatgaattcgttgagggccgaggacacggcggtgtattactgcgccacgtatcgcagctatgtaactccattggattactgggggcagggtactcttgtgacagtctcctcggctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatccggagagtgtggcggcggaggaagcggaggaggcgggtctgaggtacagctcgtccagagcggcgcagaggtcaagaaaccgggatcaagcgtcaaagtgtcatgtaaagcatcgggtgggaccttttcatcctatgcgattggttgggtccgacaagcgcctggacaggggcttgaatggatgggtggtatcatcccgattttcggaatcgccaactacgcacaaaagtttcaggggagagtgacaattacagccgatgagtcaacgtcctcagcctatatggaactctcatccctgcgcagcgaggacactgcggtctattactgtgcgcgggaagaggggccctactgctcgtcgacctcgtgctacgcggcgtttgatatctggggccagggcaccctcgtgacggtatcgtccgcgtcaacagggggtgggggttcgggcggaggaggatcgggaggaggtggatcgggtggtgggggatcacagtcagtcctgacgcaagacccagcggtatcggtggcccttggacagacagtaaagatcacgtgtcaaggggattcgttgaggtcctacttcgccagctggtatcagcagaagcccggacaggcgcccactcttgtgatgtacgcacgcaacgaccggcctgctggagtgcccgacagattctcggggtcgaaaagcggaacttcagcgtcgttggcaatttccggccttcagccggaggacgaggcggattactactgcgctgcctgggatgactcattgaatgggtatctcttcggtgcggggacgaagttgacggtgctgtgataatgataatctagactcgag

SEQ ID NO: 388 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFDSSYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFDSSYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 389 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcgattcgagctatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcgacagcagttacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 390 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFDSSYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 391 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcgaagtatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcgacagcagttacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 392 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFDSSYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 393 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcgattcgagttatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcaaatacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 394 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 395 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcgaagtatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcgattacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 396 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 397 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcggactatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcaaatacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 398 - protein, 492 aa, Artificial Sequence
  Description of Artificial Sequence: Synthetic polypeptide
DKTHTCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGEC

SEQ ID NO: 399 - DNA, 1482 bp, Artificial Sequence
  Description of Artificial Sequence: Synthetic polynucleotide
gataaaacgcacacgtgcccctcgtgtccggcaccggagtttcttggaggtccctcggtgttcctgttccctcccaagccgaaggacacgttgatgatttcgaggacgccggaggtgacgtgtgtggtcgtagacgtgagccaggaggacccggaagtgcagtttaactggtacgtcgatggagtagaagtacataatgccaagacgaagcccagggaggaacaattcaattcggattatcgcgtcgtatccgtgctgactgtgctccaccaggactggcttaacggaaaagaatacaagtgcaaggtatcaaataagggactcccctcgtcgatcgagaaaacaatcagcaaagcgaaaggacagccgagggaaccgcaagtgtacacattgccgccgtcgcgagaagaaatgaccaagaaccaggtatcactctcgtgcgccgtgaagggcttttacccatcggacattgctgtggagtgggagagcaacggtcaacccgagaataactacaaaactacaccgcccgtgctggattccgacggctcattctttctcgtgtcaaaactgactgtggataagtcgcgctggcaacaggggaatgtgttctcgtgcagcgtcatgcatgaagctcttcataatcactacacccaaaaatccctgtcactctcgaaaagctgtgataagaccgggggtgggggctccggaggaggcggttcgggtggcggtgggtcgggtggaggcggatcgggcggtgggggaagcggtggtggtggaagcggagggggtggatcaggtggagggggcagctgtccatcctgccctgcaccagagtttttgggaggaccgtccgtatttctgtttccgcccaagcccaaagatactttgatgatcagcaggacgcctgaggtaacatgtgtagtggtcgatgtctcgcaagaggaccctgaggtccagttcaattggtacgtggacggggtggaagtccacaacgcgaaaacgaaaccacgcgaagaacagttcaacagcgattacagagtcgtgtcagtcttgacagtccttcaccaggattggttgaatggaaaggagtacaagtgtaaggtgtcaaacaaaggactgcccagctcgatcgaaaagacaatttcgaaggcaaaaggtcaaccgcgggagccacaagtgtatacgctgccgccctcgcgggaggagatgacaaagaatcaggtgtcgctgtggtgtctggtaaaaggattctatccatccgatatcgcggtagagtgggaatcaaacggccagccggagaacaattacaagaccacgccccctgtattggattcggacggatcgttcttcttgtattcgaaactcacggtggacaagtcgcggtggcagcagggtaatgtgttttcatgctcagtcatgcacgaggcgctccataaccattatactcagaagtcgctgtccttgtccggggagtgctgataa

SEQ ID NO: 400 - protein, 214 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCLQANSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 4 aa, Artificial Sequence
  Description of Artificial Sequence: Synthetic peptide
  MOD_RES (1)..(4): Any amino acid
XXXX

SEQ ID NO: 402 - DNA, 648 bp, Artificial Sequence
  Description of Artificial Sequence: Synthetic polynucleotide
gacattcagatgacccagtctccttcaagcgtcagcgcttccgtgggcgaccgggtcaccatcacatgcagagcctcccaggggattagctcctggctggcttggtatcagcagaagcctgggaaagcaccaaagctgctgatctatgccgcttctagtctgcagtccggagtgccctctcgattctctggcagtgggtcaggaaccgactttactctgaccatttcaagcctgcagcctgaggatttcgctacatactattgcctgcaggcaaactctttcccccctacctttggcgggggaacaaaagtggagatcaagcgtacggtggcagccccatccgtcttcatttttccaccctctgacgaacagctgaaaagtggcacagccagcgtggtctgtctgctgaacaatttttacccccgcgaagccaaagtgcagtggaaggtcgataacgctctgcagagcgggaattcccaggagtctgtgactgaacaggacagtaaagattcaacctatagcctgtcctctacactgactctgagcaaggcagattacgagaagcacaaagtgtatgcctgcgaagtcacacatcagggactgagttcacctgtgactaagagcttcaatagaggcgagtgttgataa

SEQ ID NO: 403 - protein, 973 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSNGITYLYWYLQKPGQSPQLLIYQMSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 404 - protein, 974 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGSELKKPGESVKVSCKASGYTFTNYGMHWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPYTFGQGTKVEIK

SEQ ID NO: 405 - protein, 974 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIK

SEQ ID NO: 406 - protein, 974 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIKRTGGGGSGGGGSGGGGSGGGGSGQVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSS

SEQ ID NO: 407 - protein, 973 aa, Artificial Sequence; identical to SEQ ID NO: 403
  Description of Artificial Sequence: Synthetic polypeptide

SEQ ID NO: 408 - DNA, 2925 bp, Artificial Sequence
  Description of Artificial Sequence: Synthetic polynucleotide
cagctgcagctgcaggagagcggacccggactggtcaagccctccgagacactgtctctgacctgcacagtgtcaggcgggagcatcagctcctctgtctactattggtcttggattcggcagccccctggaaagggcctggaatggatcggcgtgatctacccaagtgggaacacttactattctcccagtctgaaatccagagtgaccatcagtgtcgacacatcaaagaatcagttcagcctgaaactgagttcagtgacagccgctgatactgcagtctactattgtgccaggaccatctatgacctgtttgatatttgggggcagggaactatggtgaccgtcagctccgctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatcgggggaatgtggaggcggagggagcggcggaggcggcagcgatatcgtgatgacacagtcacccctgtcgctccctgtgactcccggagagcctgcgtccatctcgtgccggtcaacaaagtccctgctgcacagcaatggaattacgtatttgtactggtatttgcaaaaacccggacagagcccgcaattgttgatctaccagatgtcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggtggaggtacgaagctggagatcaagcgaacgggaggcggtgggtccggtggcggtggttccggcggaggtggttcgggaggaggaggtagccaggtgcagcttgtccagtcgggagcagaggtaaagaagccaggagagtcggtgaaaatctcgtgtaaagcctcggggtacacattcacgaactacggcatgaattgggtgagacaagctcccgggcagggcttgaaatggatgggatggattaacacctacacaggggaatccacatatgcggacgacttcaaggggaggttcgcgttttcacttgatacttcagcgagcacggcgtatctccaactctcgtcgcttcgctccgaagataccgcagtatacttttgcgccagattcgcgattaaaggggactattggggacaggggacccttgtcacggtgtcatcatgataa

SEQ ID NO: 409 - protein, 973 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 410 - protein, 973 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKLEIKRTGGGGSGGGGSGGGGSGGGGSQVQLVQSGAEVKKPGESVKISCKASGYTFTNYGMNWVRQAPGQCLKWMGWINTYTGESTYADDFKGRFAFSLDTSASTAYLQLSSLRSEDTAVYFCARFAIKGDYWGQGTLVTVSS

SEQ ID NO: 411 - DNA, 2925 bp, Artificial Sequence
  Description of Artificial Sequence: Synthetic polynucleotide
cagctgcagctgcaggagagcggacccggactggtcaagccctccgagacactgtctctgacctgcacagtgtcaggcgggagcatcagctcctctgtctactattggtcttggattcggcagccccctggaaagggcctggaatggatcggcgtgatctacccaagtgggaacacttactattctcccagtctgaaatccagagtgaccatcagtgtcgacacatcaaagaatcagttcagcctgaaactgagttcagtgacagccgctgatactgcagtctactattgtgccaggaccatctatgacctgtttgatatttgggggcagggaactatggtgaccgtcagctccgctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatcgggggaatgtggaggcggagggagcggcggaggcggcagcgatatcgtgatgacacagtcacccctgtcgctccctgtgactcccggagagcctgcgtccatctcgtgccggtcaacaaagtccctgctgcacagcgacggaattacgtatttgtactggtatttgcaaaaacccggacagagcccgcaattgttgatctaccagctctcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggttgcggtacgaagctggagatcaagcgaacgggaggcggtgggtccggtggcggtggttccggcggaggtggttcgggaggaggaggtagccaggtgcagcttgtccagtcgggagcagaggtaaagaagccaggagagtcggtgaaaatctcgtgtaaagcctcggggtacacattcacgaactacggcatgaattgggtgagacaagctcccgggcagtgtttgaaatggatgggatggattaacacctacacaggggaatccacatatgcggacgacttcaaggggaggttcgcgttttcacttgatacttcagcgagcacggcgtatctccaactgtcgtcgcttcgctccgaagataccgcagtatacttttgcgccagattcgcgattaaaggggactattggggacaggggacccttgtcacggtgtcatcatgataa

SEQ ID NO: 412 - protein, 976 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQMSNLASGVPDRFSSSGSGTDFTLKISRVEAEDEGVYYCAQNLEIPRTFGGGTKLEIKRT

SEQ ID NO: 413 - protein, 975 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIK

SEQ ID NO: 414 - protein, 975 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIK

SEQ ID NO: 415 - protein, 974 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 416 - protein, 974 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 417 - protein, 976 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTPSHNSHQVPSAGGPTANSGTSGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 418 - DNA, 2934 bp, Artificial Sequence
  Description of Artificial Sequence: Synthetic polynucleotide
cagctgcagctgcaggagagcggacccggactggtcaagccctccgagacactgtctctgacctgcacagtgtcaggcgggagcatcagctcctctgtctactattggtcttggattcggcagccccctggaaagggcctggaatggatcggcgtgatctacccaagtgggaacacttactattctcccagtctgaaatccagagtgaccatcagtgtcgacacatcaaagaatcagttcagcctgaaactgagttcagtgacagccgctgatactgcagtctactattgtgccaggaccatctatgacctgtttgatatttgggggcagggaactatggtgaccgtcagctccgctagcactaagggaccttccgtgttcccactggccccctcaagcaaatctaccagtgggggaacagcagccctgggctgtctggtgaaggattactttccagagcccgtgaccgtcagttggaactcaggggctctgactagcggagtgcacaccttccccgcagtcctgcagtcctctgggctgtactccctgagttcagtggtcactgtgcccagctcctctctgggaacacagacttatatctgcaacgtgaatcacaagccttccaataccaaagtcgacaagaaagtcgagcctaagtcatgtgataaaacccatacatgcccaagctgtcctgcaccagaatttctgggaggaccaagcgtgttcctgtttccacctaagcctaaagacaccctgatgattagtcgcactccagaggtgacctgtgtggtcgtggacgtcagccaggaggatcccgaagtgcagtttaactggtacgtcgatggcgtggaagtccacaatgctaagacaaaaccaagagaggaacagttcaacagcaagtacagggtcgtgtccgtgctgactgtcctgcatcaggactggctgaacggaaaagagtataagtgcaaagtgagcaataagggcctgcccagttcaatcgagaaaacaatttccaaggcaaaaggccagcctcgggaaccacaggtgtataccctgccacccagcagagaggaaatgacaaagaaccaggtgtcactgagctgtgccgtcaaaggcttttaccctagcgatatcgctgtggagtgggaatccaatgggcagccagaaaacaattataagaccacacctccagtgctggacagcgatggatccttctttctggtgtccaagctgaccgtggacaaatctcggtggcagcagggcaacgtgttctcctgctctgtcatgcatgaggccctgcacaatcattacacccagaaaagtctgtcactgagcaagtcctgtgataaaacaggaggcgggggatctggcgggggaggcagtgggggaggcgggtccggaggaggaggaagcggaggaggaggatccggaggaggcgggtctggaggcgggggaagtggaggaggaggatcttgcccaagttgtccagcacctgagttcctgggaggaccatccgtgttcctgtttccccctaagcccaaagacaccctgatgatcagccggacacctgaagtgacttgcgtcgtggtggacgtgtcccaggaggatccagaggtccagtttaactggtatgtcgatggcgtggaggtccacaatgctaagaccaaacctcgcgaggaacagttcaactctgactaccgagtggtcagtgtgctgacagtcctgcatcaggattggctgaacgggaaggaatacaaatgtaaagtgagcaataagggactgccaagctccatcgagaagaccatcagcaaagccaaaggccagcccagggaacctcaggtgtacactctgccaccctcccgcgaggaaatgaccaagaaccaggtgtctctgtggtgtctggtcaaaggattttatccctctgacatcgccgtggagtgggaaagtaatggccagcctgaaaacaattacaagactacccctccagtgctggactcagatgggagcttctttctgtatagtaagctgaccgtggataaatcacggtggcagcagggaaatgtgttctcttgcagtgtcatgcacgaggccctgcataaccattacacacagaagtcattaagcttatcgggagagtgcggtggcggagggagcggaggaggcgggtcggacatcgtcatgacccagtcaccgtcctcactgtcggcgtcggtgggtgataaggccacaattacatgccgcagcacgaaatcactgctccactccaatgggattacatatctctattggtatctccaaaaacccggaaaggcacctaagttgctgatctaccagatgtcgaacttggcatcgggagtacccgataggttctcgtcgtcgggaagcggcacggagttcacgctcaccatttcctcagtccagccggaggacgaaggaacttactactgcgctcagaatcttgaaatcccgcgcacatttggacaagggacgaaacttgaaatcaagcgaactccgtcccacaacagccatcaagtgccctcggcgggagggcccaccgccaattcggggacatcagggagccaggtacagttgcagcagtcgggaggcgggctggtaaaacctggtgaaagcgtcaagatctcatgtgcagcctcagggtatacgttcaccaattacgggatgaactgggtgaagcaggcgccagggaaaggtcttaagtggatgggatggatcaacacttacacgggagagtccacatacgcggatgactttaaggggcggttcacgttttcgttggagacttcagcgtccgctgcctacctccaaatcaactcccttagacccgaggacacagcggtctatttctgtgcgcggtttgccattaaaggtgattattggggacagggtacgactgtgaccgtgtccagctgataa

SEQ ID NO: 419 - protein, 943 aa, Artificial Sequence
  Description of Artificial Sequence: Synthetic polypeptide
MGAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGGGGSHHHHHH

SEQ ID NO: 420 - protein, 508 aa, Artificial Sequence
  Description of Artificial Sequence: Synthetic polypeptide
MGWSLILLFLVAVATRVLSQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKIEGRMDPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSHHHHHH

SEQ ID NO: 421 - protein, 119 aa, Artificial Sequence [sequence omitted]

SEQ ID NO: 422 - protein, 114 aa, Artificial Sequence
  Description of Artificial Sequence: Synthetic polypeptide
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKR

SEQ ID NO: 423 - protein, 216 aa, Artificial Sequence
  Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 424 - protein, 5 aa, Artificial Sequence
  Synthetic peptide
EPKSC

SEQ ID NO: 425 - protein, 974 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSNGITYLYWYLQKPGQSPQLLIYQMSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 426 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGSELKKPGESVKVSCKASGYTFTNYGMHWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPYTFGQGTKVEIK

SEQ ID NO: 427 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIK

SEQ ID NO: 428 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIKRTGGGGSGGGGSGGGGSGGGGSGQVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSS

SEQ ID NO: 429 - protein, 974 aa, Artificial Sequence; identical to SEQ ID NO: 425
  Description of Artificial Sequence: Synthetic polypeptide

SEQ ID NO: 430 - protein, 974 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 431 - protein, 974 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKLEIKRTGGGGSGGGGSGGGGSGGGGSQVQLVQSGAEVKKPGESVKISCKASGYTFTNYGMNWVRQAPGQCLKWMGWINTYTGESTYADDFKGRFAFSLDTSASTAYLQLSSLRSEDTAVYFCARFAIKGDYWGQGTLVTVSS

SEQ ID NO: 432 - protein, 977 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQMSNLASGVPDRFSSSGSGTDFTLKISRVEAEDEGVYYCAQNLEIPRTFGGGTKLEIKRT

SEQ ID NO: 433 - protein, 976 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIK

SEQ ID NO: 434 - protein, 976 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIK

SEQ ID NO: 435 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 436 - protein, 975 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 437 - protein, 977 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTPSHNSHQVPSAGGPTANSGTSGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 438 - protein, 116 aa, Artificial Sequence
  Description of Artificial Sequence: Synthetic polypeptide
QVQLVQSGAEVKKPGASVKVSCKASGYTFTNYGMNWVRQAPGQGLKWMGWINTYTGESTYADDFKGRVTITADTSASTAYMELSSLRSEDTAVYYCARFAIKGDYWGQGTLVTVSS

SEQ ID NO: 439 - DNA, 348 bp, Artificial Sequence
  Description of Artificial Sequence: Synthetic polynucleotide
caagtgcagttggtccagagcggtgcggaggtaaagaaacccggtgcatccgtgaaggtgtcgtgcaaagcctccgggtatacgttcacgaactatgggatgaactgggtcagacaagcaccgggtcagggactcaaatggatggggtggatcaatacatacacaggggaatcgacctacgcggatgactttaagggaagggtcaccattacggcggacacctcggcatcgactgcgtatatggaactctcatcacttcgctcggaggacacagccgtctactattgtgcgcggtttgcgatcaagggagattactggggacagggaactttggtaacagtatcaagc

SEQ ID NO: 440 - protein, 116 aa, Artificial Sequence
  Description of Artificial Sequence: Synthetic polypeptide
QVQLVQSGAEVKKPGASVKVSCKASGYTFTNYGMNWVRQAPGQGLKWMGWINTYTGESTYADDFKGRVTITLDTSASTAYMELSSLRSEDTAVYFCARFAIKGDYWGQGTLVTVSS

SEQ ID NO: 441 - DNA, 348 bp, Artificial Sequence
  Description of Artificial Sequence: Synthetic polynucleotide
caagtgcagttggtccagagcggtgcggaggtaaagaaacccggtgcatccgtgaaggtgtcgtgcaaagcctccgggtatacgttcacgaactatgggatgaactgggtcagacaagcaccgggtcagggactcaaatggatggggtggatcaatacatacacaggggaatcgacctacgcggatgactttaagggaagggtcaccattacgttggacacctcggcatcgactgcgtatatggaactctcatcacttcgctcggaggacacagccgtctacttctgtgcgcggtttgcgatcaagggagattactggggacagggaactttggtaacagtatcaagc

SEQ ID NO: 442 - protein, 116 aa, Artificial Sequence
  Description of Artificial Sequence: Synthetic polypeptide
QVQLQQSGGGLVKPGGSVKISCKASGYTFTNYGMNWVKQAPGKGLKWMGWINTYTGESTYADDFKGRFAFSLETSASAAYLQINSLRPEDTAVYFCARFAIKGDYWGQGTLVTVSS

SEQ ID NO: 443 - DNA, 354 bp, Artificial Sequence
  Description of Artificial Sequence: Synthetic polynucleotide
caggtacagctgcagcaaagcgggggaggactcgtgaagcctggtggttcggtcaaaatctcgtgtaaagcgtcagggtacaccttcacaaactatggtatgaactgggtgaaacaggcacccggaaagggtcttaagtggatgggctggatcaatacctacacgggggagtcgacatatgcggacgactttaaaggacggttcgcgttttcgttggagactagcgcctccgctgcctacctccaaatcaatagccttaggccggaagatacggcggtctacttttgcgcaagatttgccattaagggggattattggggccaggggacgctggtgacagtcagctccgctagc

SEQ ID NO: 444 - protein, 116 aa, Artificial Sequence
  Description of Artificial Sequence: Synthetic polypeptide
QVQLVQSGAEVKKPGASVKVSCKASGYTFTNYGMNWVRQAPGQGLKWMGWINTYTGESTYADDFKGRFAFSLDTSASTAYMELSSLRSEDTAVYFCARFAIKGDYWGQGTLVTVSS

SEQ ID NO: 445 - DNA, 348 bp, Artificial Sequence
  Description of Artificial Sequence: Synthetic polynucleotide
caggtccagcttgtgcagtccggagccgaagtcaagaagccgggagccagcgtaaaggtgtcatgtaaggcgtcggggtatacattcacgaactacggtatgaattgggtgcgccaagctcccggacagggtttgaaatggatggggtggatcaacacgtatacaggggaatcaacttacgccgacgacttcaagggaaggttcgcattttcgttggatacatcggcgtccacggcgtacatggagctgtcaagcctgcggtcggaggacacggcggtatacttctgcgcaagatttgctatcaaaggtgattattgggggcagggaaccctggtaaccgtgagcagc

SEQ ID NO: 446 - protein, 116 aa, Artificial Sequence
  Description of Artificial Sequence: Synthetic polypeptide
QVQLVQSGSELKKPGASVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSS

SEQ ID NO: 447 - DNA, 348 bp, Artificial Sequence
  Description of Artificial Sequence: Synthetic polynucleotide
caggtccagctggtgcagtcaggttcagagctgaagaagcccggagcgtccgtcaaagtgtcatgcaaggcctcgggttacacgtttacgaactacggtatgaattgggtccgccaggctccgggccagggactgaaatggatgggatggatcaacacatatactggtgaatccacgtatgcggacgactttaaggggagattcgcgttcagccttgatacatcggcgtcgaccgcgtacctccaaatctcgtccttgaaagcagaggacactgcagtatacttttgtgcccggttcgctatcaagggagattattggggccaagggaccttggtgacagtgtccagc

SEQ ID NO: 448 - protein, 116 aa, Artificial Sequence
  Description of Artificial Sequence: Synthetic polypeptide
QVQLVQSGAEVKKPGASVKISCKASGYTFTNYGMNWVRQAPGQGLKWMGWINTYTGESTYADDFKGRFTITLDTSASTAYMELSSLRSEDTAVYYCARFAIKGDYWGQGTLVTVSS

SEQ ID NO: 449 - DNA, 348 bp, Artificial Sequence
  Description of Artificial Sequence: Synthetic polynucleotide
caagtccagttggtacaatcgggtgccgaggtaaagaaaccgggagcgtcggtcaaaatcagctgcaaggcctcaggctatacctttacaaactacggcatgaattgggtgagacaggcacccgggcagggattgaaatggatgggttggatcaacacgtatacaggggagtccacctatgcagatgactttaaggggcgcttcactatcacgctcgacacgtccgcgtcgacggcgtacatggaactgtcatcgcttcggagcgaagatacagccgtgtactattgtgctaggtttgcgattaagggagactactggggacagggaaccctcgtaactgtgtcatca

SEQ ID NO: 450 - protein, 116 aa, Artificial Sequence
  Description of Artificial Sequence: Synthetic polypeptide
QVQLVQSGAEVKKPGASVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 451 - DNA, 348 bp, Artificial Sequence
  Description of Artificial Sequence: Synthetic polynucleotide
caagtgcagctggtacaatcaggtgcggaggtgaaaaagccgggtgcctccgtcaagatttcatgcaaggcctcgggatacacattcaccaactatgggatgaattgggtgaggcaggctcccggtcaggggttgaaatggatggggtggattaacacatatacgggagaaagcacgtatgcggacgacttcaaggggcgcttcgcgttttccctggatacttcggcatcgactgcgtacctccagttgtcgtcgcttagatccgaggacacggccgtctacttctgtgcacggtttgcaatcaagggggattactggggacagggaacgcttgtaaccgtaagctca

SEQ ID NO: 452 - protein, 112 aa, Artificial Sequence
  Description of Artificial Sequence: Synthetic polypeptide
DIVMTQSPLSLPVTPGEPASISCRSTKSLLHSNGITYLYWYLQKPGQSPQLLIYQMSNLASGVPDRFSGSGSGTDFTLKISRVEAEDVGVYYCAQNLEIPRTFGQGTKVEIK

SEQ ID NO: 453 - DNA, 663 bp, Artificial Sequence
  Description of Artificial Sequence: Synthetic polynucleotide
gacattgtcatgacgcagtcgccgctctcgctcccggtcacaccgggagaacccgcgtccatttcatgcagatcgacaaagtcactcctccattcaaatggaatcacttacttgtactggtatcttcaaaaacccggtcagtcaccacagttgctcatctaccaaatgtccaatttggcttcgggagtgcccgaccgattcagcggttcggggagcggtacggattttacgttgaagatcagcagggtagaggcggaggacgtgggggtgtactattgtgcacagaaccttgaaattccacgcacctttggacaaggcaccaaggtcgaaatcaagcgtacggtggcggcaccttcagtgttcatctttcccccttccgatgaacagctcaaaagcgggactgcatccgtagtctgtcttttgaacaacttctatcccagagaggcgaaagtacagtggaaggtggacaacgcccttcaatcaggcaatagccaggagtcggtgacggagcaggattccaaagatagcacatactcgctttcatccactttgacattgtcgaaagcggactacgaaaagcacaaggtctatgcgtgcgaggtgacgcaccagggactttcgtcgccggtaaccaagtcgttcaatcgcggggagtgctgataa

SEQ ID NO: 454 - protein, 112 aa, Artificial Sequence
  Description of Artificial Sequence: Synthetic polypeptide
DIVMTQSPSSLSASVGDKATITCRSTKSLLHSNGITYLYWYLQKPGKAPKLLIYQMSNLASGVPDRFSSSGSGTDFTLRISSVQPEDFATYYCAQNLEIPRTFGGGTKLEIK

SEQ ID NO: 455 - DNA, 336 bp, Artificial Sequence
  Description of Artificial Sequence: Synthetic polynucleotide
gacattgtcatgacccagtcgccgtcatccctttcagcgagcgtgggggataaggcaacgatcacgtgtcgaagcaccaaatccttgctgcacagcaacgggattacgtatttgtactggtatttgcaaaaacccgggaaagccccgaagctcctcatctaccagatgtcgaatctggcgtcgggggtgccagatcggttctccagcagcgggtcgggtacagacttcacactccggatctcatcagtgcagcccgaggactttgcgacctactattgtgcccaaaatcttgaaatcccgagaacgttcggaggtggcacgaaattggagattaaa

SEQ ID NO: 456 - protein, 112 aa, Artificial Sequence
  Description of Artificial Sequence: Synthetic polypeptide
DIVMTQSPLSLPVTPGEPASISCRSTKSLLHSNGITYLYWYLQKPGQSPQLLIYQMSNLASGVPDRFSSSGSGTDFTLKISRVEAEDVGVYYCAQNLEIPRTFGQGTKVEIK

SEQ ID NO: 457 - DNA, 336 bp, Artificial Sequence
  Description of Artificial Sequence: Synthetic polynucleotide
gatatcgtaatgacccaatcgccgttgtcgcttccagtcacacccggggagcctgcttcgattagctgcagatcaacgaagtcgctcctccattcaaacgggattacgtatttgtactggtatcttcaaaagccgggtcagagcccgcagctgctgatctaccagatgtccaacttggcctcgggcgtccccgaccggtttagcagcagcgggtcgggaacggacttcactctcaagatctcaagggtcgaagcggaagatgtgggtgtgtattactgtgcgcagaatcttgagattccccgaacattcggtcagggaaccaaagtcgagatcaag

SEQ ID NO: 458 - protein, 112 aa, Artificial Sequence
  Description of Artificial Sequence: Synthetic polypeptide
DIVMTQSPLSLPVTPGEPASISCRSTKSLLHSNGITYLYWYLQKPGQSPQLLIYQMSNLASGVPDRFSSSGSGTDFTLKISRVEAEDVGVYYCAQNLEIPRTFGGGTKLEIK

SEQ ID NO: 459 - DNA, 336 bp, Artificial Sequence
  Description of Artificial Sequence: Synthetic polynucleotide
gacatcgtgatgacgcagtccccactgtcgctccctgtaacaccaggggagcccgcttccatttcgtgtaggtcaacgaagtccttgcttcatagcaatgggatcacttacttgtactggtatctccaaaaaccgggtcagtcccctcagttgctgatctaccagatgtcgaaccttgcgagcggtgtcccggatcgattttcatcgtccggatcgggaaccgacttcacactgaagattagccgcgtggaggccgaagatgtcggggtctactactgtgctcaaaaccttgagattccccggacgtttggaggcggcacgaagctggaaatcaag

SEQ ID NO: 460 - protein, 251 aa, Artificial Sequence
  Description of Artificial Sequence: Synthetic polypeptide
QVQLVQSGSELKKPGESVKVSCKASGYTFTNYGMNWVRQAPGQCLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKVEIK

SEQ ID NO: 461 - DNA, 759 bp, Artificial Sequence
  Description of Artificial Sequence: Synthetic polynucleotide
caggtacaactcgtgcagtcggggtcggagcttaagaagccgggagagtcggtaaaagtgtcgtgtaaagcctccgggtatacctttacgaattacggcatgaactgggtccggcaggcacccggtcagtgtctcaagtggatgggctggatcaatacgtacacgggcgaatccacttatgcagatgactttaagggaagattcgcgttctcattggacacatcagcgtcaacggcgtatcttcaaatttcgtccttgaaagcggaggacacggcggtctatttctgcgcacgattcgctatcaaaggagattactggggtcaggggacacttgtgacagtgtcgagcgccagcaccggaggtggagggagcggaggaggaggtagcggtggcggtggctcgggtggaggtggatcggacatcgtcatgactcagagccctctgtcactgcccgtaactcccggggagcccgcctccattagctgtcggtcgacaaagtccttgctccactcagatggaatcacgtatttgtactggtacttgcaaaagcctggacagtcgccacagctccttatctaccagttgtccaacctggcgtcgggagtaccggaccgcttttcatcatccgggtcaggcaccgatttcacactgaagattagccgcgtggaggcggaggacgaaggggtctactactgcgcccagaacctcgaaattccgaggacctttggatgcggtactaaagtggaaatcaagtgataa

SEQ ID NO: 462 - protein, 251 aa, Artificial Sequence
  Description of Artificial Sequence: Synthetic polypeptide
QVQLVQSGSELKKPGESVKVSCKASGYTFTNYGMHWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPYTFGQGTKVEIK

SEQ ID NO: 463 - DNA, 759 bp, Artificial Sequence
  Description of Artificial Sequence: Synthetic polynucleotide
caggtacaactcgtgcagtcggggtcggagcttaagaagccgggagagtcggtaaaagtgtcgtgtaaagcctccgggtatacctttacgaattacggcatgcattgggtccggcaggcacccggtcaggggctcaagtggatgggctggatcaatacgtacacgggcgaatccacttatgcagatgactttaagggaagattcgcgttctcattggacacatcagcgtcaacggcgtatcttcaaatttcgtccttgaaagcggaggacacggcggtctatttctgcgcacgattcgctatcaaaggagattactggggtcaggggacacttgtgacagtgtcgagcgccagcaccggaggtggagggagcggaggaggaggtagcggtggcggtggctcgggtggaggtggatcggacatcgtcatgactcagagccctctgtcactgcccgtaactcccggggagcccgcctccattagctgtcggtcgacaaagtccttgctccactcagatggaatcacgtatttgtactggtacttgcaaaagcctggacagtcgccacagctccttatctaccagttgtccaacctggcgtcgggagtaccggaccgcttttcatcatccgggtcaggcaccgatttcacactgaagattagccgcgtggaggcggaggacgaaggggtctactactgcgcccagaacctcgaaattccgtacacctttggacaaggtactaaagtggaaatcaagtgataa

SEQ ID NO: 464 - protein, 251 aa, Artificial Sequence
  Description of Artificial Sequence: Synthetic polypeptide
QVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIK

SEQ ID NO: 465 - DNA, 759 bp, Artificial Sequence
  Description of Artificial Sequence: Synthetic polynucleotide
caggtacaactcgtgcagtcggggtcggagcttaagaagccgggagagtcggtaaaagtgtcgtgtaaagcctccgggtatacctttacgaattacggcatgaactgggtccggcaggcacccggtcaggggctcaagtggatgggctggatcaatacgtacacgggcgaatccacttatgcagatgactttaagggaagattcgcgttctcattggacacatcagcgtcaacggcgtatcttcaaatttcgtccttgaaagcggaggacacggcggtctatttctgcgcacgattcgctatcaaaggagattactggggtcaggggacacttgtgacagtgtcgagcgccagcaccggaggtggagggagcggaggaggaggtagcggtggcggtggctcgggtggaggtggatcggacatcgtcatgactcagagccctctgtcactgcccgtaactcccggggagcccgcctccattagctgtcggtcgacaaagtccttgctccactcagatggaatcacgtatttgtactggtacttgcaaaagcctggacagtcgccacagctccttatctaccagttgtccaacctggcgtcgggagtaccggaccgcttttcatcatccgggtcaggcaccgatttcacactgaagattagccgcgtggaggcggaggacgaaggggtctactactgcgcccagaacctcgaaattccgaggacctttggacaaggtactaaagtggaaatcaagtgataa

SEQ ID NO: 466 - protein, 251 aa, Artificial Sequence
  Description of Artificial Sequence: Synthetic polypeptide
DIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGQGTKVEIKRTGGGGSGGGGSGGGGSGGGGSGQVQLVQSGSELKKPGESVKVSCKASGYTFTNYGMNWVRQAPGQGLKWMGWINTYTGESTYADDFKGRFAFSLDTSASTAYLQISSLKAEDTAVYFCARFAIKGDYWGQGTLVTVSS

SEQ ID NO: 467 - DNA, 759 bp, Artificial Sequence
  Description of Artificial Sequence: Synthetic polynucleotide
gatatcgtgatgacacagtcacccctgtcgctccctgtgactcccggagagcctgcgtccatctcgtgccggtcaacaaagtccctgctgcacagcgacggaattacgtatttgtactggtatttgcaaaaacccggacagagcccgcaattgttgatctaccagctctcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggtcagggtacgaaggtagagatcaagcgaacgggaggcggtgggtccggtggcggtggttccggcggaggtggttcgggaggaggaggtagcggtcaggtgcagcttgtccagtcgggatcggagctcaagaagccaggagagtcggtgaaagtatcgtgtaaagcctcggggtacacattcacgaactacggcatgaattgggtgagacaagctcccgggcagggcttgaaatggatgggatggattaacacctacacaggggaatccacatatgcggacgacttcaaggggaggttcgcgttttcacttgatacttcagcgagcacggcgtatctccaaatttcgtcgcttaaggcagaagataccgcagtatacttttgcgccagattcgcgattaaaggggactattggggacaggggacccttgtcacggtgtcatcatgataa

SEQ ID NO: 468 - protein, 250 aa, Artificial Sequence
  Description of Artificial Sequence: Synthetic polypeptide
DIVMTQSPLSLPVTPGEPASISCRSTKSLLHSNGITYLYWYLQKPGQSPQLLIYQMSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 469 - DNA, 756 bp, Artificial Sequence
  Description of Artificial Sequence: Synthetic polynucleotide
gatatcgtgatgacacagtcacccctgtcgctccctgtgactcccggagagcctgcgtccatctcgtgccggtcaacaaagtccctgctgcacagcaatggaattacgtatttgtactggtatttgcaaaaacccggacagagcccgcaattgttgatctaccagatgtcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggtggaggtacgaagctggagatcaagcgaacgggaggcggtgggtccggtggcggtggttccggcggaggtggttcgggaggaggaggtagccaggtgcagcttgtccagtcgggagcagaggtaaagaagccaggagagtcggtgaaaatctcgtgtaaagcctcggggtacacattcacgaactacggcatgaattgggtgagacaagctcccgggcagggcttgaaatggatgggatggattaacacctacacaggggaatccacatatgcggacgacttcaaggggaggttcgcgttttcacttgatacttcagcgagcacggcgtatctccaactctcgtcgcttcgctccgaagataccgcagtatacttttgcgccagattcgcgattaaaggggactattggggacaggggacccttgtcacggtgtcatcatgataa

SEQ ID NO: 470 - protein, 250 aa, Artificial Sequence
  Description of Artificial Sequence: Synthetic polypeptide
DIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGGGTKLEIKRTGGGGSGGGGSGGGGSGGGGSQVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSS

SEQ ID NO: 471 - DNA, 756 bp, Artificial Sequence
  Description of Artificial Sequence: Synthetic polynucleotide
gatatcgtgatgacacagtcacccctgtcgctccctgtgactcccggagagcctgcgtccatctcgtgccggtcaacaaagtccctgctgcacagcgacggaattacgtatttgtactggtatttgcaaaaacccggacagagcccgcaattgttgatctaccagctctcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggtggaggtacgaagctggagatcaagcgaacgggaggcggtgggtccggtggcggtggttccggcggaggtggttcgggaggaggaggtagccaggtgcagcttgtccagtcgggagcagaggtaaagaagccaggagagtcggtgaaaatctcgtgtaaagcctcggggtacacattcacgaactacggcatgaattgggtgagacaagctcccgggcagggcttgaaatggatgggatggattaacacctacacaggggaatccacatatgcggacgacttcaaggggaggttcgcgttttcacttgatacttcagcgagcacggcgtatctccaactgtcgtcgcttcgctccgaagataccgcagtatacttttgcgccagattcgcgattaaaggggactattggggacaggggacccttgtcacggtgtcatcatgataa

SEQ ID NO: 472 - protein, 250 aa, Artificial Sequence
  Description of Artificial Sequence: Synthetic polypeptide
DIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKLEIKRTGGGGSGGGGSGGGGSGGGGSQVQLVQSGAEVKKPGESVKISCKASGYTFTNYGMNWVRQAPGQCLKWMGWINTYTGESTYADDFKGRFAFSLDTSASTAYLQLSSLRSEDTAVYFCARFAIKGDYWGQGTLVTVSS

SEQ ID NO: 473 - DNA, 756 bp, Artificial Sequence
  Description of Artificial Sequence: Synthetic polynucleotide
gatatcgtgatgacacagtcacccctgtcgctccctgtgactcccggagagcctgcgtccatctcgtgccggtcaacaaagtccctgctgcacagcgacggaattacgtatttgtactggtatttgcaaaaacccggacagagcccgcaattgttgatctaccagctctcaaaccttgcgagcggggtcccggatcgctttagctcgtcggggtcaggaactgacttcacactcaaaatctcaagggtcgaggccgaggatgaaggtgtctattactgcgctcagaatctcgaaatcccgcggacctttggttgcggtacgaagctggagatcaagcgaacgggaggcggtgggtccggtggcggtggttccggcggaggtggttcgggaggaggaggtagccaggtgcagcttgtccagtcgggagcagaggtaaagaagccaggagagtcggtgaaaatctcgtgtaaagcctcggggtacacattcacgaactacggcatgaattgggtgagacaagctcccgggcagtgtttgaaatggatgggatggattaacacctacacaggggaatccacatatgcggacgacttcaaggggaggttcgcgttttcacttgatacttcagcgagcacggcgtatctccaactgtcgtcgcttcgctccgaagataccgcagtatacttttgcgccagattcgcgattaaaggggactattggggacaggggacccttgtcacggtgtcatcatgataa

SEQ ID NO: 474 - protein, 253 aa, Artificial Sequence
  Description of Artificial Sequence: Synthetic polypeptide
QVQLVQSGAEVKKPGESVKISCKASGYTFTNYGMNWVRQAPGQGLKWMGWINTYTGESTYADDFKGRFAFSLDTSASTAYLQLSSLRSEDTAVYFCARFAIKGDYWGQGTLVTVSSASTGGGGSGGGGSGGGGSGGGGSDIVMTQSPLSLPVTPGEPASISCRSTKSLLHSDGITYLYWYLQKPGQSPQLLIYQMSNLASGVPDRFSSSGSGTDFTLKISRVEAEDEGVYYCAQNLEIPRTFGGGTKLEIKRT

SEQ ID NO: 475 - DNA, 765 bp, Artificial Sequence
  Description of Artificial Sequence: Synthetic polynucleotide
caggtgcagctcgtccagtcaggggcggaggtcaagaaaccaggagagtcagtaaagatctcgtgcaaagcgtcgggatatacctttacaaactacggcatgaattgggtgcgacaagcacccggccagggcctgaagtggatggggtggatcaatacatatactggggagtccacttatgccgacgacttcaagggaaggtttgccttctccctggatacgtcggcgtcgaccgcttatttgcagttgagctcgctgaggtcggaagatacagcagtgtacttctgcgctcgcttcgcaatcaaaggggattactggggtcaggggacgcttgtaaccgtgtcctcagcgtcgacgggtggtggtgggtcgggaggtggtggtagcggaggtggagggtcgggtggaggcggatcagatattgtgatgacacaatcgccgctctcactgcccgtaacgcccggagagcccgcgtcaatttcatgtcggtcgacaaagtcactccttcactcggacgggattacgtacctctattggtatcttcaaaagccgggtcagtcacctcaactcctcatctaccagatgtcgaacttggcatcaggggtccctgatcgcttctcgtccagcgggtccgggacggactttaccttgaaaatctcaagagtggaggccgaggacgaaggggtctactactgtgcccagaaccttgaaattccgcggacgtttggaggagggacaaagctggagatcaaaagaacttgataa

SEQ ID NO: 476 - protein, 252 aa, Artificial Sequence
  Description of Artificial Sequence: Synthetic polypeptide
QVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIK

SEQ ID NO: 477 - DNA, 762 bp, Artificial Sequence
  Description of Artificial Sequence: Synthetic polynucleotide
caggtacaactccagcaatcaggaggcgggcttgtaaaacccggggagtcggtgaagatcagctgtgcagcatcagggtacacattcacaaactatggcatgaactgggtcaaacaggcgccagggaaggggctgaaatggatgggctggatcaatacgtacactggtgagagcacatacgcggatgatttcaaagggcggtttacgttttcactcgaaacgtcggcgtccgccgcatatcttcaaatcaattccttgaggccggaggacacagcagtctacttctgcgcccgatttgccattaagggtgattattggggccagggaaccacggtgactgtcagctccgcttcgacaggaggaggagggagcggtggaggaggatcgggaggtggagggtcgggtggtggtgggtcaggagacattgtgatgacccagtcgccctcgtcgctttcagcgagcgtcggggacaaggcgaccattacttgtcgctcaactaagtcgttgctgcactccaacgggatcacgtacctctattggtatctccaaaaacctggtaaagcgcctaagctcctgatctaccagatgtccaatttggcgtcgggagtaccggacagattttcaagctccggatcagggactgagttcacacttacgattagctccgtgcagcccgaggatgaagggacctattactgcgcccagaacttggaaatcccgagaaccttcggacagggtacgaagctggaaatcaagtgataa

SEQ ID NO: 478 - protein, 252 aa, Artificial Sequence
  Description of Artificial Sequence: Synthetic polypeptide
QVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSSASTGGGGSGGGGSGGGGSGGGGSGDIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIK

SEQ ID NO: 479 - DNA, 762 bp, Artificial Sequence
  Description of Artificial Sequence: Synthetic polynucleotide
caggtccagttgcaacagtccggaggtgggcttgtgaaacccggggagtcggtgaagatctcatgcgcggcttcggggtacacgttcacaaactacgggatgaattgggtcaagcaggcacccgggaaggggttgaaatggatgggttggatcaatacatacactggggagagcacgtatgcagatgacttcaaaggacgctttaccttcagcctcgaaacgagcgcctcagccgcatacctccaaatcaatagcctccggccagaagatactgcggtgtatttctgcgctaggttcgccattaaaggggactattggggacaggggacgacggtgacggtatcatcagcgtcgactggtggaggcggctccggaggaggtgggtccggcggtggcgggtcaggtggtggtggctcgggagatattgtaatgacacagtccccgtcctccctctccgcgagcgtgggagataaggccacgattacatgtcgaagcaccaaatcgctccttcactcggacggaatcacatatttgtattggtacttgcaaaaaccggggaaggcgcctaagctgctgatctaccagctttcgaacctggcgtcaggggtccctgaccggttttcgtcgtcgggaagcgggaccgagtttacacttacgatctcgtcagtacagcccgaggacgaaggaacatactattgcgcccagaacttggagattccgagaacttttggccagggaaccaagctcgaaatcaagtgataa

SEQ ID NO: 480 - protein, 251 aa, Artificial Sequence
  Description of Artificial Sequence: Synthetic polypeptide
DIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 481 - DNA, 759 bp, Artificial Sequence
  Description of Artificial Sequence: Synthetic polynucleotide
gacatcgtcatgacccagtcaccgtcctcactgtcggcgtcggtgggtgataaggccacaattacatgccgcagcacgaaatcactgctccactccaatgggattacatatctctattggtatctccaaaaacccggaaaggcacctaagttgctgatctaccagatgtcgaacttggcatcgggagtacccgataggttctcgtcgtcgggaagcggcacggagttcacgctcaccatttcctcagtccagccggaggacgaaggaacttactactgcgctcagaatcttgaaatcccgcgcacatttggacaagggacgaaacttgaaatcaagcgaactggaggaggtgggtcaggcggaggtgggagcggcggaggcggatcgggtggtggagggtcgggacaggtacagttgcagcagtcgggaggcgggctggtaaaacctggtgaaagcgtcaagatctcatgtgcagcctcagggtatacgttcaccaattacgggatgaactgggtgaagcaggcgccagggaaaggtcttaagtggatgggatggatcaacacttacacgggagagtccacatacgcggatgactttaaggggcggttcacgttttcgttggagacttcagcgtccgctgcctacctccaaatcaactcccttagacccgaggacacagcggtctatttctgtgcgcggtttgccattaaaggtgattattggggacagggtacgactgtgaccgtgtccagctgataa

SEQ ID NO: 482 - protein, 251 aa, Artificial Sequence
  Description of Artificial Sequence: Synthetic polypeptide
DIVMTQSPSSLSASVGDKATITCRSTKSLLHSDGITYLYWYLQKPGKAPKLLIYQLSNLASGVPDRFSSSGSGTEFTLTISSVQPEDEGTYYCAQNLEIPRTFGQGTKLEIKRTGGGGSGGGGSGGGGSGGGGSGQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 483 - DNA, 759 bp, Artificial Sequence
  Description of Artificial Sequence: Synthetic polynucleotide
gacatcgtcatgacccagtcaccgtcctcactgtcggcgtcggtgggtgataaggccacaattacatgccgcagcacgaaatcactgctccactccgacgggattacatatctctattggtatctccaaaaacccggaaaggcacctaagttgctgatctaccagttgtcgaacttggcatcgggagtacccgataggttctcgtcgtcgggaagcggcacggagttcacgctcaccatttcctcagtccagccggaggacgaaggaacttactactgcgctcagaatcttgaaatcccgcgcacatttggacaagggacgaaacttgaaatcaagcgaactggaggaggtgggtcaggcggaggtgggagcggcggaggcggatcgggtggtggagggtcgggacaggtacagttgcagcagtcgggaggcgggctggtaaaacctggtgaaagcgtcaagatctcatgtgcagcctcagggtatacgttcaccaattacgggatgaactgggtgaagcaggcgccagggaaaggtcttaagtggatgggatggatcaacacttacacgggagagtccacatacgcggatgactttaaggggcggttcacgttttcgttggagacttcagcgtccgctgcctacctccaaatcaactcccttagacccgaggacacagcggtctatttctgtgcgcggtttgccattaaaggtgattattggggacagggtacgactgtgaccgtgtccagctgataa

SEQ ID NO: 484 - protein, 253 aa, Artificial Sequence
  Description of Artificial Sequence: Synthetic polypeptide
DIVMTQSPSSLSASVGDKATITCRSTKSLLHSNGITYLYWYLQKPGKAPKLLIYQMSNLASGVPDRFSSSGSGTEFTLTISSVQPEDEGTYYCAQNLEIPRTFGQGTKLEIKRTPSHNSHQVPSAGGPTANSGTSGSQVQLQQSGGGLVKPGESVKISCAASGYTFTNYGMNWVKQAPGKGLKWMGWINTYTGESTYADDFKGRFTFSLETSASAAYLQINSLRPEDTAVYFCARFAIKGDYWGQGTTVTVSS

SEQ ID NO: 485 - DNA, 765 bp, Artificial Sequence
  Description of Artificial Sequence: Synthetic polynucleotide
gacatcgtcatgacccagtcaccgtcctcactgtcggcgtcggtgggtgataaggccacaattacatgccgcagcacgaaatcactgctccactccaatgggattacatatctctattggtatctccaaaaacccggaaaggcacctaagttgctgatctaccagatgtcgaacttggcatcgggagtacccgataggttctcgtcgtcgggaagcggcacggagttcacgctcaccatttcctcagtccagccggaggacgaaggaacttactactgcgctcagaatcttgaaatcccgcgcacatttggacaagggacgaaacttgaaatcaagcgaactccgtcccacaacagccatcaagtgccctcggcgggagggcccaccgccaattcggggacatcagggagccaggtacagttgcagcagtcgggaggcgggctggtaaaacctggtgaaagcgtcaagatctcatgtgcagcctcagggtatacgttcaccaattacgggatgaactgggtgaagcaggcgccagggaaaggtcttaagtggatgggatggatcaacacttacacgggagagtccacatacgcggatgactttaaggggcggttcacgttttcgttggagacttcagcgtccgctgcctacctccaaatcaactcccttagacccgaggacacagcggtctatttctgtgcgcggtttgccattaaaggtgattattggggacagggtacgactgtgaccgtgtccagctgataa

SEQ ID NO: 486 - protein, 112 aa, Artificial Sequence
  Description of Artificial Sequence: Synthetic polypeptide
DIVMTQSAFSNPVTLGTSASISCRSTKSLLHSNGITYLYWYLQKPGQSPQLLIYQMSNLASGVPDRFSSSGSGTDFTLRISRVEAEDVGVYYCAQNLEIPRTFGGGTKLEIK

SEQ ID NO: 487 - protein, 116 aa, Artificial Sequence
  Description of Artificial Sequence: Synthetic polypeptide
QVQLQQSGPELKKPGETVKISCKASGYTFTNYGMNWVKQAPGRGLKWMGWINTYTGESTYADDFKGRFAFSLETSASAAYLQINNLKNEDTATYFCARFAIKGDYWGQGTTLTVSS

SEQ ID NO: 488 - protein, 253 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRTPSHNSHQVPSAGGPTANSGTSGSEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 489 - protein, 1105 aa, Artificial Sequence
  Description of Artificial Sequence: Synthetic polypeptide
QLQLQESGPGLVKPSETLSLTCTVSGGSISSSVYYWSWIRQPPGKGLEWIGVIYPSGNTYYSPSLKSRVTISVDTSKNQFSLKLSSVTAADTAVYYCARTIYDLFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPSCPAPEFLGGPSVFLFPPKPKDTLMISRTPEVTCVVVDVSQEDPEVQFNWYVDGVEVHNAKTKPREEQFNSKYRVVSVLTVLHQDWLNGKEYKCKVSNKGLPSSIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSKSCDKTGGGGSGGGGSGGGGSGGGGSGGGGSGGGGSGGGGSGGGGSCPSCPAPEFLGGPSVFLFPPKPKDTLMISRTPEVTCVVVDVSQEDPEVQFNWYVDGVEVHNAKTKPREEQFNSDYRVVSVLTVLHQDWLNGKEYKCKVSNKGLPSSIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSGECGGGGSGGGGSDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKLEIKRTGGGGSGGGGSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRTPSHNSHQVPSAGGPTANSGTSGSEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 490 - protein, 40 aa, Artificial Sequence
  Description of Artificial Sequence: Synthetic polypeptide
  misc_feature (1)..(40): This sequence may encompass 4 to 8 'Gly Gly Gly Gly Ser' repeating units wherein some positions may be absent
  misc_feature (1)..(40): See specification as filed for detailed description of substitutions and preferred embodiments
GGGGSGGGGSGGGGSGGGGSGGGGSGGGGSGGGGSGGGGS

SEQ ID NO: 491 - protein, 40 aa, Artificial Sequence; identical to SEQ ID NO: 490
  Description of Artificial Sequence: Synthetic polypeptide

SEQ ID NO: 492 - protein, 5 aa, Artificial Sequence
  Description of Artificial Sequence: Synthetic peptide
GGGGS

SEQ ID NO: 493 - protein, 100 aa, Artificial Sequence
  Description of Artificial Sequence: Synthetic polypeptide
  misc_feature (1)..(100): This sequence may encompass 1 to 20 'Gly Gly Gly Gly Ser' repeating units wherein some positions may be absent
  misc_feature (1)..(100): See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 494 - protein, 10 aa, Artificial Sequence
  Description of Artificial Sequence: Synthetic peptide
GGGGSGGGGS

SEQ ID NO: 495 - protein, 15 aa, Artificial Sequence
  Description of Artificial Sequence: Synthetic peptide
GGGGSGGGGSGGGGS

SEQ ID NO: 496 - protein, 20 aa, Artificial Sequence
  Description of Artificial Sequence: Synthetic peptide
GGGGSGGGGSGGGGSGGGGS

SEQ ID NO: 497 - protein, 25 aa, Artificial Sequence
  Description of Artificial Sequence: Synthetic peptide
GGGGSGGGGSGGGGSGGGGSGGGGS

SEQ ID NO: 498 - protein, 30 aa, Artificial Sequence
  Description of Artificial Sequence: Synthetic polypeptide
GGGGSGGGGSGGGGSGGGGSGGGGSGGGGS

SEQ ID NO: 499 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 500 - protein, 45 aa, Artificial Sequence
  Description of Artificial Sequence: Synthetic polypeptide
  misc_feature (1)..(45): This sequence may encompass 1 to 15 'Gly Gly Ser' repeating units wherein some positions may be absent
  misc_feature (1)..(45): See specification as filed for detailed description of substitutions and preferred embodiments
GGSGGSGGSGGSGGSGGSGGSGGSGGSGGSGGSGGSGGSGGSGGS

SEQ ID NO: 501 - protein, 60 aa, Artificial Sequence
  Description of Artificial Sequence: Synthetic polypeptide
  misc_feature (1)..(60): This sequence may encompass 1 to 15 'Gly Ser Gly Ser' repeating units wherein some positions may be absent
  misc_feature (1)..(60): See specification as filed for detailed description of substitutions and preferred embodiments
GSGSGSGSGSGSGSGSGSGSGSGSGSGSGSGSGSGSGSGSGSGSGSGSGSGSGSGSGSGS

SEQ ID NO: 502 - protein, 25 aa, Artificial Sequence
  Description of Artificial Sequence: Synthetic peptide
  misc_feature (1)..(25): This sequence may encompass 1 to 5 'Gly Gly Gly Gly Ser' repeating units wherein some positions may be absent
  misc_feature (1)..(25): See specification as filed for detailed description of substitutions and preferred embodiments
GGGGSGGGGSGGGGSGGGGSGGGGS

SEQ ID NO: 503 - protein, 40 aa, Artificial Sequence; identical to SEQ ID NO: 490
  Synthetic peptide
  misc_feature (1)..(40): This sequence may encompass 4 to 8 'Gly Gly Gly Gly Ser' repeating units wherein some positions may be absent

SEQ ID NO: 504 - protein, 60 aa, Artificial Sequence; identical to SEQ ID NO: 501
  Synthetic peptide
  misc_feature (1)..(60): This sequence may encompass 1 to 15 'Gly Ser Gly Ser' repeating units wherein some positions may be absent; the 'Gly Ser Gly Ser' unit could also repeat indefinitely

We claim:

1. A Tandem Fc Bispecific Antibody ("TFcBA") comprising a large chain and a Fab light chain, each chain having a C-terminus and an N-terminus, the TFcBA comprising a Fab moiety comprising a first binding site comprising the Fab light chain and a Fab heavy chain, wherein the Fab heavy chain is at the N-terminus of the large chain, wherein the Fab moiety specifically binds to cMet, and wherein the TFcBA further comprises a single chain Fv (scFv) moiety at the C-terminus of the large chain, wherein the scFv moiety comprises a second binding site that specifically binds to EpCAM, wherein:

(a) the large chain comprises the amino acid sequence of SEQ ID NO: 410; and (b) the Fab light chain comprises the amino acid sequence of SEQ ID NO: 400.

2. A pharmaceutical formulation comprising the TFcBA of claim 1 and a pharmaceutical carrier.

3. The pharmaceutical formulation of claim 2, wherein the formulation is a sterile formulation suitable for one or more of the following: injection, intravenous injection, and infusion.

* * * * *